United States Patent 7,332,281 (THERAPEUTIC TARGETS IN CANCER) - sequence listing, part 3

SEQ ID NO: 128 - DNA, 811284 bp, Homo sapiens
  misc_feature (1)  (811284): n = A, C, G, or T/U
atgtatttacccatatctcttttgtctacaggtggctgttcctttgatgagcactacagcaactgtggttatagtgtggctctagggaccaatgggttcacctgggagcagattaacacatgggagaaaccaatgctggaccaggcagtgcccacaggtatgtgatccatcatgtttggggctgtaatggggatggctagtttttaccgtgaatcatggggggaagaacttacttacacattgagctctctgagatggcaatcgatagctctgtaggtagtgagttccccacactcagaggtggtcaaaccaaggctgaatgaattcttcaggatttgatactagtcacatgtcacctggattcagcatttcttttagcgtcgagattctaagctttagctacaagtaggtatcactgggttttgcttgggagcctgatgatagtggcgtgtcagggaaagagcttctgaagaatttacggtcgctgcttttcttccaggccacatggacataggttgtatatatttagggaaacttcaacagtacagactattataaggttatattaattatattattatattattgttatatattatcatattattatctattattgtgtgttatattatttacatatattttatatacttagggagacttctacagtcagattattataaggttatatattatattatacattatatatgttacatagtatatatattatataatttatatatatatttagggatacttccacagatttttataaggtcatattattatataatatattattattatatattattatattattattatatattgtattataaggtaaacatcctgacattctaaataccaaccttttgtccttaaccagcagcgctgaaggcctagtgtgaattcttgatggatacctgcatggggcaggcctgtgaggtacacctgatatgtttcaggggaagtacccaaaggaggtcttctcagagagaacacttagactctaaatgtggggtatacctgcgtaaggtgcatcttgaagaggcttacctggtgatagaagccaggaagagttgtgactctgagaaagtgaagctcacttttctgaataatcacatgtccctgctgcagttgtaaagacaactgcttgttggagaagggaggccattttctacagtttctgcttgaccaaaggctccctcactttaacccacacctgtcttggttttcaccaatcccccaggtgctctttctcagtctcccctgtcagtgcactctggccatggagtattaagagttcttcaggcttactgggtgttctttctgtggttggcctcaaccactcccatggcctcagatactgcctctgtgctggtgattctgacatttatgcctccagcctagatgtctcaggaattttacacctacacaacccactgcccagctgccatgtcatcttggctacctctggagaacggggttttccaggatgctactaaagtgggagcaaagaagatgctcagagatgcccaggtgagggtgtggcctcattcactttgagtctggctccaaaacaggaggcactggatggttatggatagctcctattaagggcattaattgtataaatttctcaaaagtgttgatacaagccttaggtgtaataaagttaggctgtggtacaaaattgagcatttcagatctggtgggaccttactttgaatgagcaaagtcatcaacaggtgtgcatgcctattagcaaggcagtgtggaacaacctctgtctgttgcccaatcatgctgactttaaaaagtactgcctggtttacatgatagaatcacccatcccattagggaccccaagaatccaagacacctctgcttaaacatagcacatctgctctactcttcatggccctccttgatagtggcccaataaatctggatcttatagtgtgtatacgtgtgtgtatgcgtgtgtgtgtgtgtatgggggtgtatgggtgtggtgtgtgtgcatgcctgtgtactggtatgtgtgtgtgtgtgtgtgtatgggggtgtattggtgtatgtgtgtatgcatgtctatgggggtgtgtgtctatgtgtatgggggtgtgtgtgtgtgcatatgggggtgtaagggttgtgtgtgtatgggtgtgcgtttatggagggtgtgtgtgcatgtgtatgggtgtatgtgtgagagtgtatgggggtgtatgggtgtgtgtgtatgggggtgtatgggaggtgtgtgtgtgtgtccgtgtgtttgtatgggtgtgtgtatatggcggtgtgtgcatatgcatgtgtatgggtgtgtgtgtattcacatatgctctttctgctcatctttagtccacttaaagccctgtagcatgttgtaggctctccaagctcaacatctccaaaactgaactcttgatttacccatttccccttccctgtctactcactttccactgttcctcgtctccagaaagctcacttcaccctactggtactgattcagaaaccggggggccatgtttctcttttttctctctcttacccacttttccaatcaatcactttgttctgccattttacttcctaagtatagtttgggtctgcccaagcctctccatctctgccaccactgccctggtgaacacaaccattgtctgtttcctgggtaagtggaaaactttctaacagactccttgacttaactctttggactttaatccattctccaaacagatgtcgaagagattattctagaatataagcatgttcatgttacttcttttcttccttgtctctacccagcttctgtcttaaggctttctgaggcttctcattgctccaggaaagaccaaagccctgttgtggtctccaaagctctgagtgctgatcctccctaaacctccaaatcatcatcatgctccacatcccactctgctcactttacactggcttctgccaattgccagaatgttctgactctctcctgcctcgggaactcacatgagattggcatcctccacggagcctttcccctacctactgtcttgtgcgtcctcttcatatctcagtctgggtcagcattctttgtaatggttcccgttgcaccttgcacttgtccttagtagcacgcatcacagcaggtgttattcatccagtgcatggtttactcccagatgagaagttctatgtgaatggggaccatgagaatcttgttcataactttatcttcagtgcctaatgcagtacatcagacatcctatgtactaaattagcaatttgttggatggatgtgtggatgggcaaatagtctttattaagtgtttttattaatacaggaatgaatgaaaaaagattaaaggcctttgggtgctttactaactgatcatgtattttcctctttgctactatccttcccattttacggatcagaaaaccaagttctaagaagctgagtaaaagtgtgtctttttactcatgctactctctctccccaaagacatggcttttgcttctaatattaattttctcagcccctcattatggcagggtgtcatttcataaatattggatcatgctaatacaatcttctgggcttttctaaatagaggcatttgataatgatcactgaaattattctgtcatgatgcgcctgtggatttcagcagctctgtgtgcctcttaggcagagaggcatgaaagcgaatttggattaggcaaaactgtttgttcttcttatgggcataggctgaaatcttgcttttctttctgtaaagccagcagttctcctcatcttggaagtcaagtttgagtctgtttattcagatgttccacagctttttgcccatcccctttgtatgacgagctccctgctatacttggtctgggtaactcattccatgtcattttgggacttaatcctgctgatggcctcccctggcacataggatgaaatctgaaatccttgtcatggcctataagatcctgcatgatccaatgtcttctttgggccccttttcttctcctctctcatacctggtgtgttttagttcctgagatgtgtcagattctttcttggcacgggtcctttgcacatattgttccttgttccttctcaccagaatttgttttctcaattcttcactttgttgatttctctttcgttctttggttgtctctctctctctttttttttttttttttttttttttgagacagagtgtcgctctgttgcccaggctggagtgctgtggcgttatctcagctcactgcagcctccacctcccaggttcaagtgattctcatgcctcagactcccaagtagctgagactacaggcgcacatcgccatgcctggctaacttttgtatttttagtagagatggagttttgccacgttgaccaggctggtctcgacctcctgacctcagttgatccttccgcctcggcctcccaaagtgctgggattacaggcatgagccactgcatctggcgctttgctgatttcttcatgtctcagctcacaggactcctcaaggcaatcttcccttatccgtctgtctaaagatggacttcctccttattctcactcataacatcctgttctttgctttcaaaatcgttatcatagacatgtttgcaagtcagtgtattccaatcttacacaacagctgagtgaccctagggtctcaactcccagtttccacatctttatcttggggaccagtgtgagagttaaatggaggatgtctgcatgagtgtgaactgtctgcctggagtaggggttagtcaatgctggtttttctaaatgttttctggttcttgcaatctctggggctggaagtccaagtccacctgagaccttgcccccacttctagctcactgatgctgctttacaaaggcgagctgctcagcaggtgttctactgtgggtcctgacaggccagagaggcttttcaagtccaggatgcattgctgcatcgagggcttagacatttcctccaccccacctctgtgaattgaatgttacacacacctactgttatttgccattgaaagtaatggcaaaaaccacaactacttttgtgtcaacctaaatacagacttttcctcatctctgtccatgggagaagctcttgcactagcattccaggcttcagacctggtttcactaccttatcgttattgaggctgtcacagaggagcaggggttagtacactcactcacaaaccctctctctagctgtctatcctgcctatggaactaactacagctaccaccagttcctagccctgccttccccatctttggcatgggtttccacaagtcatccctgaggtacagccctgaattacagcccagggcccagcaggagggcatcctgggggctgaaggaagatgtgagtgctggaggtatccttcggaaagggctgaagccagaggtagtggggcttgggtggcttgcttctatatcctttgaatacttgtaggacattcttttaaacataaggtatggattagggttgaatatcaggttgcaaaatcaggtacataagaaatactcacttatttctcttctttacataaacctgaatctgaccctcagtccccagggagctgagactatattttaggcactgttggagctccctcttccctagggttctatgagtttcctggggtttcagcagactgttgtgattttctctgggaatcccactgctgcattccctttaggtctagtgattctgctgctgctttctcaggctaggagccattgtcacagcccagccagcccaggtgcaccacccacaaacccccccgggcctgcccctcctcaggtactgccacggaggagtgtggcaccagcagatccatacctcccaccttcgtaaaatgggagaacctctctcctcaccatcttagccttcaaaagcacacccttcttggcccagtccttccagaccccagcattctctcttaagtaagtttagagttagaaaaaacaaaggaggaaggaaggaagccttgatttcaagcagcttcttctatttttcctacacacatttctagagcagaaaaatacaaaaagcttagtgagtttccagattggaaggaggaggagttgggagaacacacacacaggtgacacacatgcacatgcacacacacacacgcgcacacacacacacacacacacacatttcacccaactagcatgtcatggaagcagcaccgtctccagggtggtcctggcctgttccttcacaccatggggcctttccctgtgggttcctgccttgctctaactgctcatgtgtctaaagggagggttgaggtctgtttgggttgaatggtgtctcctaaaaagataagttgaagtcctaacccctgatatctgtaaatgtcacacttaattgaaaataagtatttatagaaatgatcaaattaggatgaggtcaggctggtcatattgggttctaacccaatacgactcgtggaggcaaagatacatacacacatagggaaggaggccacatgcagatggcagtggagattggggcaatgcagccataaggcaaggaatgctgaggattgtcaacagaaaccagaagtcaggcaaggcaagttgacgggttcttctctagagcttttggagacaacgtggccctgccaataccctgattttggacttctagcttccagaactgtgagacaataggtttctgttgtcttaagccacccagctcatggtaatttttaatagcagttctaggaaactaaaaccaggtcaattacacatcagtaccctgaccccatcacctacccaggttaccttttccacacgagctctgtaagtattggaagctttgctttcttctgtttttttgttttgttttgtttttttgagatggagtctcgctcggtcgccagggctggagtgctgtagcacgatctcggctcactgcaagctccgcctcccagattcacgccattctcctgcctcagcctctcgagtagctgggactacaggcatccaccaccaggcccagctaatttttctgtatttttagtagagacggggtttcaccatgttagccaggatggtctcaatctcctgacctcatgatccgcccacctcggcctcccaaagtgctgggattacaggtgtcagccaccacgcccggccagcgttgctttcttctaagggagctggcatttactacttgtccactctaactaagaagtgggttaggcatcatcctgtacaacattttgtctaatgtcccaccatcccatgagttcgagatattgtcacttgtttttgagaaaacagagtcccagagaagtgaagcaactggtccaaggtcatgtgagttttatgtggctgaggagtcaggcttgatgtccaggctagagaaatatatattgcagacatggtactgttgtcaactaagcatctttaaaaattgtttctacttgcagtcatgatttatgatggcaaaaataatgtgtattcattgttgagaaaatgctcaatagagatagctataaagaatgaaatgaaagtcatatgttcacacaaacttgcataaatatgtattttgctatttaatacttttttctttagcattttcccatgtcattaaatgttccataaaaccatgttttctaaaggtttcatagtttcccattgcaatgactgttccacgatttatttcatcaccccatattgttgcatatttaagtcctttccagttactcctgaatcatgttgcggtgagtattcttgtacatacatctctgtgctcatctccaatagaagttatcgaatttgttttcatatgtatatatttctgtattcccttatatacccaaaacagaatggttgtgtattatctttgacatctggagaaggaatatcatccacatggcaaacatgtagtcctggacatttgcccatgacttgatggttgggaaaatgctttgcaaattctgaagcactaaacacaagccaggcactgtcgatggtcccctgattgcaccttgttctagctcttagcttaggtactccctgggctttagcaagaatagtgttggaaatattgtcgaatagaatggtccaagcactagtcaatccaggtggatgctagctgtaaaaagctgtgtgggctccctcatgtttattggatgaactgcaagcttgttcacgggccataaacagagctagcttcggttcttgtaggcaggaacaacattgtatttatatttgtaaccgcaatgctggggcttagtaggtagcggcaaatgtttgttagatgatttgctcttattaataattgaactttctcatgatgcgaccccagcatgtatcttgagcctcagtgccccctcctgcccttttctctttcatttccccttctgtgtaatcacacgagagcagcctttgtgttattgttttgggagtccagtctccaaccctgtttcttgatttggggtatctctcattgtgttgagtctcagtggattgtgtagctcgctgagaggtgaagatgccagctgctcatcatttcctggcagcctgggtgtggctgaataggtaacctggatgcagcaggtggaccctgctgcccaggacttttcatctaggaaggatgggccagcagccagaggctggagaattggggtgtgcagtagtaggggtggtgtctggccatggtgtttgtgctacaaagttgctggacttcttgcttgttgatctcccagaactcccttttttttctgcttatttttcaggcctgatccttcagctttctgttcattatgagcttctcaatattccagaaacttcgtattttttaaaagatagtcatagttgatatctcttgtttcaaccacaaaccctacaggtcacactgtcgtgcctttgtacttgctgatccctaaggctaagagcacagctccacttttccttcctcctaaatcaaaccccggcacaaatgtcacctcctccaggaggccctccctgactcccctcacagcgcttacctctctactatgcttctgtagctgagtttatcacatgttgtctctgattccctactaggcctgtgagtggctgcagggtatggactgcctctcgttgctgaattccttgtatcctgcatggggcctggaataaggaaggcggttatttaaaaataactgaattattgttaaagttattcgtgttgggaaagttgggagaaagtggtttcaggaggaccctaaaggggctgccacttgctttggcattttcgtggcacctggggcatctgtagctttcatgtcttgagcccgactctgagcttgacgaggctttggtcaggatgggccacttggtcccaggtcctgattggtctgggttcttctgctctgaagttggtcccaggatccttcgggcaaataaagagacactggggatgatcccttccttcgctctggggcctggcacactctcatgaatgtgtggcactgcttgtgacacatgtaactggctcctcttggaaagatgtaatctattctcagattgacctactcttcctttaatgtgaggcttacaataaaatcatatggaagtatgggcctttaagtgtccttaatcacacctgatattattattgattggtttaaagttgtaagttcttatgttcccatttagcaattgttgagtcagtacatttttttctttcctctttaatgacaaaatattatatatttattcttaaaaaatgctgagtttgaacatataagttacctctctccaccctgattacagttagcctaaatatcaccattaacatattgatgtgttttgagagagaaagggagagagtgaaggaggatggagagagggaaggaggaagacagagagtatctgtatgtggtaatagtaatagagacgtactacctatgtagtgcttactatgtgtcaggtactatcctaagtacttgaaatatagtaacttatttaatctttgcaacagtcctctgatgtagatgctgttatctgcattttacagatcaggaaacctaggcacagaaaacttgaatgacttgcccaggtcatcgttagcatatggtggaggcaggacgtgcccttggaaagggtccaggctgtgctctggacagctgcactgtggccacttaggagtgtagacagtgaatagaatcatagctcccaaactcttctgtcatccatctctttttatgccactgtattcagagttagttttcaccttccaaggctacatgatattctcctgggtgaatgaaccatggtttattcaactaacacctaagagatagaggtgggagaagaaagaaatgccagaatgccttctgtgtgcccaaataaaagacaagatctttgtctccaaacagctctgagaaaagttcttacaaaacatctcatattataagatggtttttcgtgtacttggagctacaaaattaattgtagaaactacattagcctgcagtgaccccaatcagtgctagtttgggatgtttacagggatcacagaattgatagaaaaggcaaggaaattgaacgcaggtttagtaattattccggaggatatgagcaagtaatgacgagtgttggtgatggttatgaacaagtttcctaacaatgtcctaacaatggctttgaaaagcaacatgatgtccttttggtgatcagaatatacagctgccagataaatgggaaaacctgtctgtgctaatatccacatagatgcttgccttgacactcagttttctgtgacatcatacctagattcaaaaagtattatattccaaatggtgtaatgggaagtgaaagtgatggagactggcatcgttcaactaaaaaagtgcttcttctgatgacaaacactgctgcatttgacgagttagaataaaggggttgtctgggaggcagaggttgcagtgagctgagactgcgccattgccctccagcctgagcaacgaaagcaaaacttcatctcaaaaaagaaaggaagaaagaaagaaagaataaagaggttctaaagtctatgtgaatggataataaaccactatgtcttttaacctaacatgtgtataccacttcctggacagtgttctaagggctttacatgtttttacatcgtttaatacttcaacaacactgtgagctggatgttattatcacccttattttaaagaggaggaaactgaggcccagaatgtcaactctctcaaaagtgagttacagtaaatggaggagctgagatttgaattcaggccgtctggatccagaatctgtgccctgaaccactctctatttttcaattaatattttatgaaacgtgattttaaaatgtatgtgtaattaaattgtatattagataccataagtggacttttgcctaattcaatcatctgtacacttaaaattgtatttattaaagttgcccgaaaactttttttttgaggagaggatgtcttctcactggaaaaatggaagaaatgctttacttttaatggagggttgatcctgtcagtttgttgaattgtctaagtctgtcagtgtctctgtaaatgcagatacagtgaacctgcatgttgttcggagtaaattctttgaaaaggaagcatcacaaaaacagtcgtgtgtcagcgacacatttaacaggaccacagagatgacgttcttcaagattcctctgtttcctgctgcttcaactttagccactcccagggcagccggagaggaagacgttgctgagaatcatcctgatcatggtgatgctggctggatgctgatgctaggcgatgtcttcgtggaccattcaaccgattgggctgctgcaggggctagagctcctgcaagtgaacctttcatttttaaatgtgtgatctgtcttttccttagtaaagaaacaggttttcattatgctttggctattatagtaatttgaattacaaatatgcattctaagatatttggtaagaaaaggaaatagtttagtataaatatagtcttttttccccagtttagtaaaaacaagatggctgagatgtctctaaaaaataaagtccaacaatctggaaaatccagtaatccattgaggtcccatttgccatatctaatctggtggtcattagccgcacatggctacggagtactggaaatgtggctagtcctgtaagtgtaaactacacaccagatttcaaaaacttagtatgaaaaaatcatgtaaaaacatcttattaataatgtttatgttgattacatgttgaaatgattatattttagatgtattgggttagataaattattaaaagtaacccatttcttttttacctttttaaatgtgcctattagaaaatttagaattgcatacgtggctcacattgtgtttctattggtcaatactctcctagattattagatttttatgacgtcacttgtattcccaccaacagggatatctctctttgagaatagtaatagctagcatttataaagcactcattctgtgccaggtgctttaaagccttgtttcctttatggttcacaaaaccctatgcagtgtaggtaacatgtgttcccactttatagatggaaaattgaggcacgaagagattaagcaacttgcccttcatcatagaggttggaagtgctgggaaggggatttgaaccaaagcagctcaagtcagtggcacccactgatgactcccaggcatccaccttttagcacatggacataacacttctgtctctgccttgctctgttgacttgaacctctggacctcagttttcctacccaggattgggtggaaacatgtgattttaaatatgtagaacatattaacaacagagctacctcaggcccctctagctctgttcttcctgtggttattattgtggttctgtgtgggctgcaggcacatggtggaattgggtaggcattatctctactgccaggcctttggttagcatggccttctgcctagtggctaaggaagcatccctgggaactcatcccagatctgtcactaacctcagactttgagctgcctttctctgggcttcctacacccacttctgtgaaatggatctaaaaataaggagtcctggattctgtcctagctctgccattaacttgctctgtgaccttgggccacacatcatccctccctggaccttattgaccattgtaatatcagaagtcagtttcttctgactctagcattctttgacttgtaatttatgaatcaagaagaaggcatttctaaacataggaatttagtgatacatttataaaacaaaacattggtgaagactcctgtggtcctaacccctccattcgtctgtctgtcaagcagggcaactgcttctgcttctttgcagaggaatttgtcttcatgagtatatggaggtagggcacctgacgtacaatctatccctgagagcccagaccttcacagaaagataaatctcccagttgagcttaaggcacgtactctgttctcacgcatccttgcagagctgcagtgatctatcacatgccccattaatttcacaggtacaactccagaatttatttccccacaactactaatcagtgagacatttggtaattgagagaaattacccttttctaaaaagacctcctgttttccctcttcatctacctagttttgacactgtgctctgtgctgacacgatcatactttatgtttggaaagcaacagatatttgagcaaactgtttttaaaactttcctcaaatctgccaatatcttttaaaattgcttcctttcctaggtgttgtgtttccttattaagaaacccaaattgcactttctcaggattcaaagccttgtagtcaatgaaacaacttgtgaaagctatgaacaagcaagaatatgttatgtcttttaagaactctgagagtgtctaaggttaaaataagacctatagcttccaagatccttctaaatcatagctgcaaacatatataagcatgatgtgtccatcagtttggattcaggtaggaaaacggaaaccattctaggtatttcaatcaggaaggggtttaatacagggtattagaggtttataaaacctttgaagctctcacatacatggtcaaataatcttcactaagggtaccaagactacacaatggagagagaataatttcttcaacaaatggcatttagtaaattgaatatccacatgtagcagatccttaacttacaccatacacaaaaattaattcaaaatggattaaagacctaaacatgagagtgaaaactgtaaaacccctagaagaaaatgtaggtagaaagttttatgatgttggatttggcagcgatttcttggatataacaccaaaagtacaggcgacaagagcaaatatagacaaatgagactatatctaacttaaaactaatgtgtttcaaagggaacagaattaaaagacaacctgtggaatgggagaaaatatttacaaacctctcttgtagggttactatctggaatacataaagaatgcctaccactcaacaataacaaaacaaataacctgatttttttttttttttaaaaagggctgaaatagacatttgtccaaagaagataaacaaatggtgagaaacatgaaaatacggccaggcacggtggttcatgcctgtaatcccagcattttgggaggccgaggtgggcagatcacctgaggtcaggagttcaagaccaacctggccaacatggtgagaaccccatctctacaaaaaatacaaaaattagtcaggcatggtggcgtgtgtctgtaatcccagctactcacgaggctgaggcaggagaattacttgaacccgggaggtggaggttgcagtgagccaagattgtgccactgcactctagcctgggtaacagagcaagcctctatctcaaaaaaaaaaaaaagaaaagaaaatatgtttagcatcactaatcattagagaaatacaaatcaaaaccacaatgagatatcaccttacacccattagggtggccactataaaaagacaaacaaaaagaaataaacgtcaagcatctggaaaaattggaacctttgtacattgtttgtgagagtgtaaaaatggtatagtctatatggaaaaccaaaaataaaaaatagaaccaccatatgatctagcaatcccagttcttgaaatagaatcatgtatcatttaatgatgggaatacattctgagaaatgagtcattatgcaatttcatcattgtgtgaacatcatagactgtatttttgtaaacctagaagctatagccaactatccacctaggaccaccttcatatgtgcagtccgtcattgacggaaacaccattatgctgcacgtgacagtatatctaaaataattgaaagcagaatcttgaaaatatatttacacactcgttaattgtagcattattcacagtagccaagagatggaagcaacccaaatgttcatcaacagatggacggataaagaaaatgtggtatacgcatacaatggaatattactcagccttaacaaggaaggaaatcctggcacatgctacaacatggatgaaccttgaagaccttatgttatgacagataaatcagtcatcaataacatgtactgtatgattgtacttatgtgatgtatctagagcagtcaaacttacagaaataaaaaaatagaatgatggttgccaggggctggggagaggagggagatagggaattgttcagtggtgtcttagaccattcatgctactataaaaggtaccacaaaatgggtaatttatgaataatagaaatctgtttctcacagttctggaggttgacaagtccaagattaaggcaccattatgtttggtgtctgatgaggaccccatttctatttcaaagatggtggcttgaatgctatgctgtcacatggaaggacaaaaagggcctacctagttccctccagctcttttataatgttgctattcccattcatgagggctctgaccgcattacttaatcatcttctaaaggccccaactcgtaatactgtcactttagagtttaagttccaacatgtgaattttgcaggtacacctgcacttaagccacagcgttctcctccagatgccccaaaatccatgtccttctcatatacaaaatacattcattccatctcaatagccccagaagtcttactcctgtatcagctttaaagtgtaagtccaaagtgtcatctaaattagatatgattcatcttgaggcaaattgctctccagctgtgtgcctgtgaaatcaaattgtatacttccaaaatacaatgttgggacaaacacaggatagacattcctattttaaaagagataaatagggaagaagaaaaggtaataggtcccaagtaagtataaaacacaagaagacaaacagcattaaatctcgaggcttgagaatgatcttctttgactctacgtcctgccttttggacaccgtgcagcaagggtgggccaaagacccaggcagccccattcttcatggctttgctgggcgtgccccacaaagcagctctcagtggttggggttgggtgcctgtctctctcccaggcttgtgttgcgtgatggtggctctacaggtctgaggtctcaagggttgcccatctccatggctccatggaacattgccctaataggggttctctgcagtggctgaattcccatgtctccagggaattgcactagtgagggttctcagagcagccccacccaccctggcagttctctgcctgggcactgaggctctccagggcatcttttgaaatctgggtggaggtagccatgcccccacagcttatgcactctgcacacctgcagggtcaacaccatgtggatgccaccaaggttgactgtttatgccctctggaggggaagcctgagccacacttgggctcacttgagtcacatctggggcatctaaggagcactacaccagaattcagtaagcagagacttgaggtggcacagagcagcgagtgctgaggtctcatgggtgcccaagatcccttttttcatacagttttgtcccccaggccatggcattctgggcctgtgatgagagtgacaactttagagatctttgaaatgccttcggagtcattctttcattgtcttgataaatagcatctggcttccttacacccatactaataaccctatcaggcatcttaatatttttatcaaacattgactcagccacactgttggtattctctccataatatacctttatgtcctggccaggctgggaattttcaaaatctttaagctctgcttcccttttacttataaattcatctttaattgatttcttatctcacttttactataaacagtcaagagaagccatgtagcaccctcaacactttgcttagatacttctttcaccagatatcctagtttatcacctgcaagttctccctttcagaaagcattgagacatgggcatgattcagccaagttcttggctatcttgaagactatgagttttcctccagtttccaatatcttatttcttgtttctgtcagagacctcatcagaattgcctttaccatccatatttctaccatcattctgtttgtgactatacttataatatctaagaagattgagcctttctctccagctttcttcttttgaacctttgccagaaacacccttaatactctgttcacaataatctagactctttgcagcatgaatctctaaagtcttccagcttctactcattacccatttctaaagccacttccacattttatgtatttgttacaacactctacttctcggtattaatttccgtcttgtccattcatattgctgtaacaaaatgccacaaaatgtgtgatacataggctgggtgcagtggctcatgcctgtaatctcagcactttgggaggccaaggcgggcagatcacctgaggtcaggagtttgagaccagcctggtcaacatggtgaaaactcgtctctactgaaaatacaaaaattagccagatatggtggcaggcacctgtaatcccagcttcttgggaggctgatgcaggagaatcgcttaaacctgggaggtggaggttgtggtgagccgacatagtgcctctggactccagcctgggtgacagagtgactctgtcacaaaaaaaaaaaaaaaaaaggccatatgtaaatttttaaatttatgtctcatagttctggatgctgggaattccaagtttaagatcaaggtgccagcaggctcagtgtctggtgagggcccagtctttgcctctgtcattggtgaagactgagctggaaccctgccagaaagtaagatgtagtttctaggcttccagccccagtgatatgtgggtgagcttaggagggtaggaatgatacaagataccatgacacaattctcagtacagtgtactctaagtgagtaaaaaaaaaaaaaaaaaaaaaaaaaaatctgtgttcttttcacatagaagaaatgaacagaagtgtgaacattgaaatcaggctgatattagttggaatgccaattctactagtgactagcattctgatatggagctggtttggtaacctgtctgagcctcatgctcgtctctaaaatgaggataagggacaagagcctcataagacttatgtggggaattaactaaaatttcacatacaaagcaccttgtacaacaatggatattttatggccaccctaccttgcagtcactttagaattttgatgaggagtttccagcaccaagaggtgtctacttccagtgagatacctcaaagtatgtggtatgttcagagaataacaagtagtccttacatggtaggatgacagtgatgacattagtatcaggtagcattttggagcatctgttttcatggcactgtgctgagcactttatacttgtcatctttcttttattaagtctttacaacagccttttgaaggagctagtggtaacagcccattttacagttcagaaaaatgaggcacacaaagattaagtaatttatttaaaatcacacagaagtggcagtgtgattttatctaaaatcacacgtaagtggcagaggcaaatactcaaaccaatactcttgaataatgtagtattctaggaagggataccatggtcatgtggcataggatgagatgtgatgagaagggaggttggggccacaacttgaaggatgttgcatgataagagtgaggattcatcagagattaagtcagggaatgtttgatcagatttatcttttaggataaccacttgttggccagtgtgaaaggcaacttggagcagcagggagcctgtggtgggaaggaaggcagtggaccaggagggaactgatcaggcatgaatggggatgttagctgtaaaaatggggaggaggaaaagggggttggaggtatcggtgagctcaagaaaacttggtgaaagagatgaacaaagatactggatttgggtgtggagtcaggtgcctattctttgaagttctgtgactctagccaagccacgtgggttccatttcctcatctgtatattacacacatacctatagaggtgtgctaaaaatggccaggatgctcatgcagagaccctacctctgtgcccacaatactgggttcttagcaagtgaaagtgttggcccagtgtttgatgcttaccagaccttgggtctcagtgagcaggtagactgaacatctgcatcagaatcaccgagggtatttttaaaaagcagattcctgggtcctatcccaacatgtggcactgggatggggcccaggaaacagcaggcaattttagtacattgatcttgagaaccactgggtgtttgggaagctaggaaaggggtcaaggccagggtcaagatttcacaggagaaagggaagagcagaggggagagagcagaactctgcacattgccacaatctagggtgtgggtagaggaatgggagcctgagaaggagacggagggagtgcattcctagaggaagacaggaataagccggcattccaccaggagcacccagctccttcccttcttctttcccctgcggagaattggcaccctgggacacctctttgttggagctgttgcttgcatccctgtagtttcttcctctacctgctgtactttgccatccccttgtcatcactgccatgttctttcctttgccttggagaccactgggtctcagaatcccattgttcttccagcccctgtcccaggtcaggcagtgcgggagctcaatacagaggagctctgtgtaattttgcatttaacacccatcttcctcaatgaactataagctccatcagagcaggaagcaacttttccattcacagctatgtgtcctcagctcctaaaactggcaccagaatgccctcaatgaatattgaataagtgagttaggggatgagtgaagtgttcagctatttggaaacagatttaaaggaaacagaaaatctgaggtggctgaaacatacacttgtggttcagagcatggtgctcagtgggtctcaggagatccgggtctgctgtgctgctgacctgctgtgtggcctgaagcaagttgcttagtctctctgggctccagtggccttaacctatacaaggaagagccctgattaggtaatactcccagttttctaactctaataccacacaggttctataaagcagttctgctgtggcatactttgttcattactgcaaccagggaccacatgaaaagacttcacaatacaggaatgaagagagtcttgagtgcacgtggaggtggtagcagcatggagcagatggggcctggcaggccagagagccacctggagtatagttccaacctctggaaaataaatcttatttttcttttctgggtgatggcaacaagtagaagaaagcctgaatttaacactccatgctgattgaaaaaattatctgattttgaccatttcaaacaaaatgtcacctttacaagcctgatttttagatttgtgctaagtttttagactttgcaatatggaaaataataacagaaaggttattgcctgaattgaaagactactttcctgtgtttgaaataaaactttgataaccttggtctttgattctctgtacagttgaatttcagaaaagagattccagaggcatatacacgttcaaggttcagggacactatagccagagggactagtgtgggggaccttgagcaaagctattgagcaaagtttctctatggctcaaggttttctcttacttataaaatgaaggtcatgcaattgggacacatagggattgaatgacaaacatttgagaacacacagaacaaaatgtttggtgcgtggacccatgttgggtctcctccatcaccatcaagcagcttcttcttgtcctgtctcagagctgggactcagcatggaggtgccttggtaacctgtgtactgatggaaaaccctgaggacttgttaggcctgccatccctctcctctctcccctctcccctcctctctctgtgtgtgtgattacatgtgtttaacactaggtgggctgtaatgttcatcatcgcctactggccttctttgaagacctgaggccccttatattgagtggctgctggaggttctttgtccagtgtgtgcttactgagactcagcagaaggccctggagtggccagaccttgtcattttagtcctggcctggggcagaaacgcccacacagggtctcacttgccaatgtcaggagtggatagaggagagccatcacttgattgagagaggggacctcagtttgcagaaaagggacaggaacagggctgaagggtcctttgcagactacagcatcctggccaggtagctggagcgacttcctgaacacctgtcagctcctgactcttcagactttacagggacccctggtatctctttcctgccttggagaaagctgcagaggtggggctggaccccagggtcatctcctcttgaaagagatgtcacatcatatggtagcaatatcctctgactgagatctggggcttttcatggtctgcccactttcctcagatcctttacagcaagaccagctttcaagtccacccttttcaagatccgtgtgttgtaattagggggcagggagtcaggttaggggatggagtttacatccctctaaaacccaggaagaagaaatgaggagctcacgaccactgacatgtccactactttaatcttacttaggaaatgattttaatgaatccataagtttttagggttggatcttgttcatcagttactactcatgaattcgtgagcatttgtgatctaaagtctgaacatcactatggcttgactcttgttctaaagaggaagaaaacatctgcattgaatgatctccaaatacaaggctagaccatccttccctgctctcatttctagatagtcacaaacagagtagcacctggatggacctcaggcagggatgtagtctcctgtcctgattctctgctggaagttagcattctgtggtgtagatgcaagaaaataggtgtccttcgtggtcacagctgctgtaggcacttcattcacatttacaaaattttaagatcatgtcctcttcttttctaccaatataactacaagacctcacgctttgctagagctcaggcactgccaggtgtcatcatgaggagagcacgggatttcctatcacatgaatctaggtttgaaccctggctctgctgttcaccaacctgttaccatctactacagaggacttctctgaatctcagtctctttctctggcaagtgtgaatgggagtacaagtctgccttaccccattagtgtaagaagccatcaagatagtagaagtgcatatgctttgacagctcagtgtctctgtatgggttagtttttgccactattattgtaaccttgaagaacagctgggcccaagcttcctgttataaagaaatacagtgctctcagctaaaaagaccaccccctgcttacccacccagtccctaagagggtggattataactgttgtggctgtaaacccagccgatatgggctgtaatgtagtaaattatcacttgttttgcagtcttgacgagaaaaataaatgcaattacactcatgaatgttgaaaaatgaagcaaagcaatgcagatcggcacattcgaggtgcttttccaaacgaaaagctgtgtacaatgaatgctaatgggctccctccctcccactctctggcatatggtgtgatgtgatctttctgaattaagaaagcagctttgccaagcaccctggctatgggagaggtggtcatgaacagcccccacagtgggagactcagcaggtggaccccaacttcctctcttgcttgaggacacacaatagacccaatttcctggagcaggcaccagagtgatcctggtgcagcctctctgcttcaggaacttgccatctattttgcagttcttctgccatcctgtgtggcaaacatttgctgaacacctaccatgtgccaggcatgatgctgggagctatagagatgagtctcagatatcttgcccctctcaaccaagggaggccttgtgagccaggcctgatgtgcaccatgtagccttgagtggttcaatacagtggcctccagcacttgaaatgtggccagttcaaactgagatgtactctaaatgcaaaatacaccagatcttcaagtctttgtaccaaaaaaaagggtaaaatgttgtgttaatttttatattgtttatatgttgaaaagatagtgtcttgtgtgtgtgtgtgtgcgtgtgtataaccttttgcaatatggcaggtagaaaatttaaaagtataaatgtggcctgcattgtatttctgttggacagtgctgatctagcagctgcctatctctttattcacatcctctgccacattcccccttgctggtgataccctggtctgtttttttttggttttttgtttttttttaaccacaccaggctctctcctgtctcaaggcttttcacttgccgaaggctcttctcagcaagagcttgcatgtcaactcaactcaaatgtcaccttctgtgagcagtattctctgactagcctttttgaatatgtactccctgttttttgttttgttttgttttgttttgttttatccagacactctttctagtccttatcataatatttggcattttattcatctacatgtttgtgtaactgttttccctaagagaacataagggcagaaggcttatctgttttgttttatttagttttttttaatgtgttctgatctcagtgtctagcacaacaagcaacacatagtaggtactcagaattttttttcttaaatgaatgaatgaataagtgtcacgttaatttcacaaaagaaaaaaatattttgattattttgagatgttgaaaaatacatttgaaaatacttcccactgggtcttaatttatcaatcagttagggaatgtctaggcaagaagcatgtgagagatgaatgatttaaatggggtttaatgaaatagagattggatcagaatcaagggaattaacaagggatagtgaagcacccagggactggcaactttgggaagccattaccaccctgggtctgaagggcaatggtaggaaatagaaatggtgctaaagtgttaagggattgcttgacaggctatagaggaacacagccaccccctggtcttctgtccatggccaaactctgccattggttaaactcagctagaagcagagagtaaggaagcctgggagatacagactacagaccactatgtctaggttggtgggtgaaagtggtgatggaggaacagagaataatcgtcatccttaaaagacctagaaagctatttccttaatgtgacggagcctgtctattccaaactaacaactgatatcctaaaaatataaggatgctcaggaccactaaaattatttaacatttattcagggatttctagtaacagaatgggaaatataattatggcataaagttattatttgcagaggattttattatctaccaaaaccccaagagaaataatgaaaaactattagagcccaataaaagagtctaataaggtgactagttagggaataaatatacaaaaatgaaaaattttctaaataccaatcaccagttaggaaacataatataaaaggattcattctgtaaaagcaacaaatataaaagcctgaggaattggcttaagagacaatttgcaggaactgtagaaggaatctataaagcaaaactgggaaaacaaataagtaaacggaggtatttcatttctggatgggaaggcttggtattttaaagctgtcaatttaaaatattgaatgcatattgcaatagaaatgtataagcaatgttataaaatgattttaaggtttatctggaaaaataaatgggcacagatcatcaagcaaatgttgaaaagagaatgatggagaaagacttctacttccaagttttagaaatatatcctgaaactaaaatagttcaaatagcttataccaatcttagaagagacagatagattaacagaataaagtatgtccttaaaacagaggggtgtgtgtgtgtttgtgtgtgtgtgaatgcatgcatgtgtacatgttatagacaaacttcacatttctaattaatgagacaggtcaagatgaaatgataatccaccaggggaggatgtgggttcttcatactatgtaccaaaatatattctggataaatgcagtgcatttcagttaaatgtaaaatttggaaaacatagatgacatttaaagaataaataaatatttaattttggggagcaggacagttttctgatgataccattgaaggtacagccataaagaaaaatattatatctttgtccctaagaacctaaacatcatgaaaatatccatatcaaactggctgggcacggtggctcatgcctgtaatcccagcactttaggaggcccaggcgggtggatcacgaggtcaggagatagagacgattctggctaacacagtgaaaccccgtctctactaaaaaaatacaaaaaaaaaaaaattagccggccatggtgccaggtgcctgtagtcccagctgctcgggaggctgaggcaggagaatggtgtgaacctgggaggcggagcttgcagtgagccaagatcgtgccactgcactccagcctgggtgacagagcgagactccatctcaaaaaaaaaaaaaaattaaaaaaaaaaataaacaaactgagctcagatatgtgcattatatgtgcaaaaaatgattgatataattaacatgtaaagaggttttaaaaatcagtaaaaggaaaaataatccggcagacacacatcagtgttggtgagacctctggcaaccaggtggccatacactgttggtataagtacaagttggtacaatatttagggacaacaacttaaaaagtttctgagcagataaatgtacactttatgtcttcatgacttcatgaaattctgggtgtgtgacctatgacatggtgcttgacctcccagagtgtcagttattccgttcataacatgagaagataaatcaacttgcttcacaaagtggctgtgagggtcatttgggatgattggcccaggaaatcattggagttatgaaaccctgagaaaatggtgtaccttcttgattaatgtggggttgtcacattttgcttctcttccccacccccagccacttgaacgctatctactggagtcccttctcctgacgctgcagctcattgaggcacaaaggagagagtaagagccctaaacctttgtcagggtaagcagggctgcactgagggtgggtgctcagctgggctcagtaagtatttagtaccaaccacttgtgctaggtgctggggtgacaaagactctccccttgaccaaattttagtcatgctcctctgaattcccttctcaactaggctttgattttggctatcttgtctgtggcctgtctagcccagttttagcaagaactctgctaggttagcctactgaggatcccccaaccccttgacatctgtcagtccagttgggcttctataaaaaagtaccataaactaattcttagcaacagaaatttattgctcacagttgtagaggctgggaagttgaagatcaaggtgctagaagattccatatctcgtgagatctctcttcattaaaaaatgacaccttctagttgtgtcctcatgtgatggaagaggcaaggcagctctctggggtcccttttataaggacactaatcccattccttcatgacctaattcatctccccaaagtcctcatcgcttaataccatcaccttggcggttagcgtttcaacatacgagttttggcctccacaaacattcggatgatagcactatctgatcatcctggcctgccttcggtaagaaccctggtaagttgttttagcaagaatctccctacccttgtctcctcttggtaatttttcatccactcactctgttccttggctctaaatccccagctgtctttgttatatttgcctaatttctctcctccattgcaataatcttgaataatgtcttccttaccattttaacaagtgtcagagtaattttatttttaacaagtgttaccatggcaggtaaatctcagtctgccccaaagtagctttgggtctaataggtagacaggtaggcagatccatgattgactctatggaagaggaacacgtattcatgaattcaacaaacatgtactgagggcctgtaatatgccaggcactgaggatacagctttggacaagatactccagctccttgctctcatgaatctcacagtctgatgagagagatagatgataaacataaacagaaacagaaaaagtaaaaagggggcaggtgtcattcctgggattgtagagggaataggggtcccgcataaacaggagacaccttctgcaggagaagacatatgagttgaatctccagtgaatttaactcttgcttgtgggctacaagattcgacaggttcagagctcatctaagcatgtttgtgaataagtacgatgttggatgactcaggagccagcctatgatttgccgattgtgagtaggaagacagctgaggtttctagaggcagcccagctgagaggagacacagacagggagattatcctaataggatttcacaaagaccacttagcagtcgctgagctccagggaaaaacagttatgagctgagggtggggaaatagtcaagaatctggcaactccgcagaagctcggagagaaaagctgacagccgacagacagaacaagatgatgcttgcaaaaaggttaaaagaatagacaagagagaaaaaatgtacgctgagagatatggatggaaatggaagtgcattaatataacttggggatatggattaagataattctagctctaaggagcagagctaggacttactcattacagtacttcacactgtcaggaaactcttggaaacagatgtgggcagtggaaggtcaggatttggatggaaagaaagaatgtgtgaataggcagaaacaggatagctagttctaacccctactctttagagaaaaagaaagtgaggttcagataaataaaatgactttttcagagtcatgcaacatagtgagtgctagagctaagagattagaaccttgtacattgccgatgggaatgccaaatggtgcagctaatgtggaaaacagttggcaatttctcaaaatttaaacatcaagtgactatgtgacccaacaattctgtttgttgggcatgtagccccagaaattgaaggcatgtactcagatttgattcatggtaggttttctggctagtccagtgcccctttttactgcaccccagctgttgcttccatcttccattttctctcccttttttctcctcctttttccctcccaacatcctatcttcatccctcttctttcctctttatacatgtagggtcaggttggggtctaagctatagctttgccacttaataaatacgtgaacttggtttttattgtcctgtcattgacgatgactagatgagggtcctccagccctaatagtatatgcatttttacatactgtgccgtcacatgttcaggaactgcagcggatctagtattgatgagaggacagtacctgggaggttgcccagaagacaaccctgggggaacctgggggtgttgtcgagaagctgatacactcccggtcttgaacaactgtcatgttttctcaccctttaattgcttgtttcgtagagcttaaattctctttaattttcctgggattacaaagcagtgatctatttatgtttcctggagcatctcttcttccagggtgagttttaaaaaaaaatctttgcgtgtgaaacctactgtgggggacacacaatcttcctttaagtcttgtacttttccccctctacttgaccactatatcagtgggggcagttacctgatggtgttatttgatccaaattggtaatgctgaatttgcctttgctattttcccaatttacttggttacagtttgactgctctcttatgggagaggaaattgctgaggacttgcaaaaagcctctgggggctttgtctctaatctgtctctaaatttattgaaattctgacactagatttaggtctattgaattgtcagttgatcctcttcctggggtgggtggtcccctaaagcttcagtttgctcacctgtttcaaaatgagtcagctgctttaatgagaggtccttctgtttcatggacttttgtcgtttgtttttctaaacccattcattttcttgtctttgcccatttgagtcctcatatgagataactggtttctgcctgataattcccagaatggctctgggaagggatttagggaaggagtcaatccaaaatgggaaaaacgagctccaagtggaatattcacacctttccaatttgttctcttcaaattaggagctatatcattcagcttttctgtccattacacattttttttttccttgccaacagtacttttccatcttgaaagggaggatgggctgggttcgatggctcatgcctgtaataccagcactttgggaggctgaggtggtcagattgcttgaggtcaagagttctagacaagcctggccaacatggcgaaaccatgtctctactaaaaatacaaaaatcagctgggtgtggtggcgcactcctgtgatcccagctacttgggaggctgaggcatgagaatcccttgaacccaggaggtggaggttgcagtgagccgagattgtaccacagcactccagcctgggtggagtgagactctgtctccaaaaaaaaaaaaaaaaaaaaaagcatgaacatagattactcttctttcattttggcccaggtggcacttaaaacctatagcatgaggttggggcagtttctgagtttcagaattaataatatttttgttgttcattttaattcattttgttcatttcagtcaactttgaagatggaggttctgtgaaatggtgtgcaaaccaccatattttctggaatacctggcattctttccactataccatgctgtgtgattataaatacactctttcatagccagtatgacatgctcttattggaaaaggtttccaatgactgtattcactgaaatggcctatttatatatcaagtgtgtgattggatatgtgcttccctaagactaaaacaacaacaaacaaaaggcccagatcctgggttacccaacgatgctgccaggtctcccctagttccctgctcccaaatgttcatgtaaagttgccacaggaggtctcagtagtgagcgccttcaaactgggcaatgggattaggtttttagaagatgatttccttgttttcatttcgagatcttaattttattgaagatgcttctgctgttggtggtgctggtataactgatctaatttaatttaatttgcttctttgcaaagaaggcaatcccttgcccagctgctgctctgggcagagaggaagcaagcaggcttggagataagccatgaactttatcagacctctccaagctttatgctaatgagcaatgcttagagatttcagaattttttcccccagtgattgctttagctactgtactgtttcctaggcagtaagacatcatcatgagtctctataggtgagggagatgtgatcatctgactggtctgttactctgcttcaaggtaccatgcctgtggtgggtgcaaggcacatgtcaggtggtgttaggaagagtttcccccacccattctgtcacagtgtgcctagggaagcttcctgtgagaattctgagtgatagcaggtgtggtaagttaaacagtccttgattaaactctggttgtacctccctagtttctttcctttgtcaaggtgttcaaacttgctatgtcttggcctccttaaaccatgcgtgaataggatgtgtgcttcaaggatagagttccttattcctgtctctattttcagtacctagtaaggtgcctgccagacagtaggcttggtaagtatttgccaaatgaacgaatgaatgaacaaataaaaggaaacaaatgggtacgtatggaaaggaagatggaatgtcaccattacatcctactctccagacagaaacactctgggtataaggagatccagagtcatgttgtgacgaggtattgtgagccgtaatggtactgcaggtctccccagttctactccaatgatttgatttggtgggttggaaaggatttgttgacacagatctagacatatatgtgatttgataatgggtggtacagaattagcccattttccatctggtcctgcccagatttgctcagccacggggttagtctattcagatccagctcaactttgctgtattttaggagcccatctctcaagatagtagtgattaaagtcagcctgctggcgcaatcctggcatgcagtcattctgaggaaaacgtatacaaggttgtgatggttaattctgagtgttaaattgattggtctaagggatgctcagatatctggtaaaacattaattttgggtgtgcctgtgagggtgtttctagatgagattagcatttgaatcagaagacttagtaaagaagtctaccaatgtgggcaagcttaatccaatcgttcgagcaccagaatagaacaaaagggcagaggagttcattttttctctcttttcttgagctaggactcttctcctatgcatgggcattggagcttctggttgttgggctatcagacttccagacttacaccttctcatcctgggttctcaggactttggcctcagactgagagttataccatcagccatcacctcttctagttctcaggctttaggacttgaactaaattataccactggctttcctgattctccagcttgcagacagcatactgggggacttcctggcctccataattgcatgagccaatttccataagtctcctcttatatatctttatatattctgtcggttctatttctctggagaaccttaactaatacaaagttcttcatatgaggcttctgcttagttttcttgattaagatggtgattcctgaatgagaccaaaatactcagggccaagccacatgagctaaaaggcactgacaatgctgagttaatgtagatatatcagaccaaagggtgcctgagatttagcttctttgctcttatcctgaaatgcagcaaagctgttgcttcatcatctagcttctgactctcagcatccccatctcctgatgccttcacttgaacatctttgctgggcagctccaccaccatctttgactcctcaagtatgctagcaacctgggtggaacctgcatttgtcatattctcttggccactctgagtgaacttgtgttcactctctagggaggtctaggtttcccagtgggtttctgcagccccacctacctctcagtctgttctcttctgcacccaagcactgtaaaattagtacaagcctcactaactagaaggcatgttgataggtcagatgagagggtttgtgaaatagaggaggtatctaggctgggcttggtggggaacagaatccatgaatgaaggctgtatctctaggatgagccagtggagaaaaatcctcaaactgatggaaaagaaaaaatactctggctctgaaaatcaaaggacatagccctctgaacaagtgtgattagtattctaaaaaaatatatgaaggaggcatcaaagaagaacccattggcattagcaagaggttttagggaccagatacgaaataaatttctaaaaaaaaattagcaggttttttctatgtgcagtttttaaattgtaatatatagagcaaagaaaaacccaatcataacaggacagaatatcttttaaagcttgggatgaagataaaaaaaatgcaggaacaacatgaaaactttaacacagaggcacataaaagaagacttgaatacttggaaaaatatcatgtttctgaatggaaacgtgtattcatataaatatgtcaattctcccccaaagtgattacatatttatgtttttaaaacttgacaaaaatgattgtaaagtttggatagaagatgaaatgcataagaatggcaaaagggacattttgtcccttaatagaagggagatttgcacagcaaaaagttacagagagttataaaataacttaatactataagcaatttagtggctagtgaaataaaatgtaattgaaacagaatacaaaataagataatgaaaatgatttgtgtctatgtaaatacttactatgtgataatggtagacttaaatcgttttgggaaataatagattatataattaatgctgttaggaaaatcagctttttagagggaaaggcagatcattatctcagtccgtacataagcatagattgcaaactatggtgtacaggccaaatctggtttgctgcttgttttgtaaattaaatgtattgaaacatagccacacccattcatttacgtattgcttgcggctgctgttgcaccaccatggcagaactgagtagttgcaaaagagacgatatggttgcaaagccaaaagtatttactatctagctctttacgaaaaatatttgctgacccctgctttgacacatggagagcaggaacttgagctgaagcaatagcaaataaacaggaaacatcttattctctatggttggggtgacatatttatttttgtttcaatagggacatttttgagagtaaaaggaataccccaggtaggcagggaggtattataattatagatgcctataatggatcaagaattggattggaaagggagaaatgcaagacagtgatgattagagttgagtaagattagagttaataaagttaagaataatagaaatcagcgttgttaaaagcacagtcttttaacagcagaaaggagccttgtgagtcttcatggatctttagatacttttgatagaaagtagtaactcagttattctcagtgtcacaccaggcagaatgctatttattatgcaacataaaagcagaggcaaaaactcaagtacttcttgagctgtgcagggaacagaatagatgtaagacaagaacaaaatgttcaactctaatgagaggataagaacattagaagactagtatcttggatgtttgaaacagtggagaatggccaacaggaaggaacagctgtaattaagtgcagatctaaagaagtggcagaaaaactgtgccttgcaagtttgacttagcaacgagccagctaccaagagccctaatgaggaccaaagatggaagatgtctgtggggagtgagacccgggtaatcagcttgttttttcccgtctgtgagttttccatctgatgagaagaaagggcgtcaggaggtagactggtccaagggctgctctttgaagacacctgatctcaaatcactaccatggtcaggaggggatgctccaaagtgagctccaggaaaatagctttgcagataagcccatgggcctctaagcaccttccctgttgcttggagaaaaaggaccaggcctggccatgggttaaaccagcagctggcctcacaaaggaatgtgtaagtgccactgcctttggggttgacactgcagtgcagtgggtgtatagcaactgaacaaaaaggactgactgcctaccactgggggatgccaaaagactcgcctgtagaaggcacattcacaacactggttaatggcccagtctcctaacataaataaaatgcctccatccttacatatccagcccttgccataatgagccacagtccatctcacgttaacaaatgccttttcaggttgggcctgattttccttagttattccggttcggacgttaaaatgacagagttagtaattggagggcttcagaagaatcaattagtccagtgcttttcaacttgaggacctgggaatctgggaaggagaagtggtagtgcttgaagcgcttttagtatttcaagatgcctgtgcctacactatacaggttcaaagaaatctcaagttctttgggttaggtttcaaattcaacccggtgaacaaagctgtgatctcatgctgctcagaaacctgaaggggggaacttgctttgattaggagaaaatggaggaagaggtagtccttcacaaattcagtttatgcagtggacaagcctttcataacatgcagcccagggagaaatgtagtcatagggaaagttgagaaccccttggcttatccattgtgtaatctgtgtccttccatttaataggtgatgaaacctggacccagaaggaaatgggacaaggtagcacagcccaagttgtaggaaacagaaacagcaggattaacttcctctaagtctgagatttaaaggggtagacataggcatctggagacctggagttcttgtaggggtgaagagctaacatttattgaggacttactgtgtgttgggtgctgttctagaaaattcacacacatcgtctcatgtaatccctagagtgatcgtgtgagttagagattattctctgaaagattcagaggaggaaaacaaggttcatggagtctaagtgacttttccccaagatgatgtaataataatggagctgggttctaacagagtgtgttgtggcccccagggctgatgctctgcccactgtaccaccctatcttggagaatgaacctctatgggttttggctaccctaggggcatgtgaggagggagtttcaaaattgtcctcttgggaaaaagaaaccactggacagtgcctgcatctgatctgtttccactttccccagaagcagtacatgcctgactttctgtaaatgttggattaattgatttaatttagttgattgtcactccaaggagttctgtgaaagaacaatggaactctgaattcaggcctagagcaagtgggaaagacttaggaggaggctggttgtcatttaagagaaagtgggacttcctaaaatggacctctttcacttagcaaattccacttaccccttggctgtcagaaagacccctgtttcctcagcatgggtactggtataaaaacaggcacatagaccagtggaacagaatagagaactcagaaataagcccaaatacttacagcctgatcttcaacaaagcaaacaaaaacataaagtggggaaaggacaccctattcaacaaatggtgctgggataactggcaagccacatgtaggagaatgaaactggatcctcatctctcaccttatacaaaaatcaactcacaatggaacaaggacttaaatctaacatcagaaaccataaaaattctagaagataacatcggaaaaaacccttctagacattggcttaagcaaagacttcatgaccaagaacccaaaagcaaattcgacaaaaacaaagataaatagatgggacttaattaaactgaaaagcttccgaacagccaaagaaacaatcagcagaataaacagacagtccacaaaatgggagagaaattttgccatctatacatccaacaaaggaccaatatccagaatctacgaggaactcaaattagaaaaaaaaatcccaacaaaaagtgggctaagaacatgaatagacaattctcaaaagaagatatacaaatggccaacaaacatatgaaaaaatgctcaacatcactaatgataagggaaatgcaaatcaaaaccacagtgtgttaccactttactcctcctgcaagaatggccataatcagaaaatcaaaaaataatagatgttggtggggatgtggtgaaaagggaacactttacactgctggtgggaatgtaaactagtacaaccactatacaaaacagtgtggaggttccttaaagagctaaaagaacaaccatttgatccagcaatcccactactgggtatctacccaaaggaaaagaagtgattatacaaaaaagatacttgcacacacatgcagcacaatttgtaattccaaaaataggaaaccagccctaaactccatcaatcaacaagtggatgaagaaattatggcatgtatatgccatggaatattacccagccataaaaaggaacaaaataatggcatttgcagtgacctagatggaattggagaccattatcctaagtgaaggaactcaggagtggaaaaccaaacatcatatattctccctcataagtgggagctaagctctgaggatgcaaaggcataagaatgacacaatgactttggggactcggggaaagggtgggaggggggtgagggataaaatactacaaattgggtacggtgtatactgctagggtgatgggtacaccaaactctcagaaatcaccactatataacttagtcatgtacccaaataccacctgttttccaaaaacctatggaaaaaattttttaaagacctctgttttctaacaggatggaaacatcactgcctcttgccctgtcattgatgcaaagtctaaacagtctcaaggtgaacatggtaggcccagggaagtcctgggagtgtcacctgtgggtggccttcccttcagccagcagatcactcaactgtggcagctacaggtctgtgagagacattgatggctgtggcatgtgactctaaagccccatttagtgtcccagtgatgagggctgaacacgtatatccaagttgatgcccatggatggagcaacatctcgtgccttgagtgcttacttcctgggcagattgagagctgtgctagtggtgttcacgcgaccctttcaatccatctttacccacctccaccctgctcactgccctgaaaggctggcctgtataggctctgccaatgcccttggtcttctgtatggccagaaatcagaggggggcggggagtaagagtgttctgtgtacttattccctgggccttccctgtgtggttgctatgggccagccgtgtgtcttgactgaaggttgctgttcctctcaaggggatcttctcgcccctgttctctcctgctggcttctgttaacgacttcctcccctaatcccttccatccccgtgggtgctctgctacacttacccttgtccttgcccgctttgtacctttgtaaatattccctttgttaacttgccttggattctcctcattcgaacatgcccagggtgaccctgattgattctctaggcattaactaatttgatcttcataaaaactggaggacaaggagactgttattatcaccaccctcatttttaaaatgagaaaacacaggcatagaatggccccattgttttctccagagtctcattgtttgtaaggagtagagacagagtttgcatctggcttgttcctgcacattttctaccacagcactagggtacctacttccattgattcttttcgagggagacctaagacacaggaaaacaaaggaaaaaatcaggctctgtagccttcttggaacctctgtccccaggcccagtccttatctcaactttccagagctccccacttcagaaggtaggagccaactagccacatgggaaaccagagctcctgaggggcagcgaagagaaccctaaagaggtcattccccagacagctgggcttgcaactcattcacttaaattaaaactttatcccctatggtgtttgaggctcaccaaatgcctgtagccattgtcccaagctttgtattaagcaagagtgcctcttcttgcagcccctagaagccaagaatgtgagatcattactgtggtagtttgcttatgaagggtgaggagccccagcaccacagccatggcgaacatctggtacagatggggccagtctcagtccttccatgtatggctttagtgctttggaagcttttgccttaagcctgacatctgcttctgtgatgcattttgctgagctctcctcagagggggcggtcaccacaaggtgttccattaggtgtcttaataagccttgtaactgcagcccggcatgcctctcccctgcagagctgctttctgcatgaggatgggaagggtggatagttcagacataatttgcaatggcagcaggaatattatttttgcgttataaagcatggcgagtgaccttatcaaagtaggagaagtgagcaggcagcaagtgagggcatccatggttctgggtgacacacggaggctggtgggtggtgggcgtgatggtggtaaggttttgaggccctcagctgccttgtagcgtccctgggggctgcaggatgctcagcttcccttgcagacccctgcaagttctgtctttaatagacctatgctgggccaagtaggtgtggctgtctcatgactgagaacaaggattttgtctgttctttgagggcacccctgggtttaaccctgagccctggaccagctggaggtctgattctttacctgcccagttcttctctgccatcatttctcagaagcttgtgctatctctgatttcctgaggtgttctgggataatctcgcttgcccttaaccaagtgctccatacatgtcccatttctccagaccagatcacagagctctgttcatgcctgtcttggactcctgcatccagctcatacccagggagttctctgccatgcccttcctccattgcttgtgcagcaggtgggctgtgtgacccacgtgggtatagcaggtgtgtgccctctcaacaaggagagtccaggattccagacttttttaagtactctctggagcattcgtagaaaactcagagtcagatttttctcagaccacacactctgtcacacacatgtgcacacacagaaacacatgcacgcccttcaatttatgattataattatgatttaggatgagaaacaggtttatataaaatcataaacctgcatatatggaaaagatgaccttggatcaccaaccaatataacactcccattttacagagaaggcagttgagatccagaaggagaagtgacttggccattaccacacaagacagccctttagctttccccagtctggacctctgaggggcaagaacacccgaaacagaaacaacagtggacatcgagcaaggcactggtctgactgctccgaggatcctgagtacattcacacactcaggcaagggaggggtgggctgcttgcttaccagtgtctagacactttggtcttaggcagcccccttctcccacaggggcatcttcatccttaccttcatagtaacaagggatgagagctgaatctgatggtccccgtcaagcaaagcactagccactcccagagggctggttcttggagaccgcaaactctattgtcacattggcagaaggtgctgggagaatgaacctgaacaggtgggtgggatagagagtcatggaatggcaggcagggaccatgggtttcctccagactaggcagcttgccaaatccccgtacgcccatctcctagcatggggtctgacccaaaacaggggctcgaactgatgaatgaacaaacgccagagcagtgtgaagctgattctagatatgttgaaggtacccaaggactttgtatttttggtgagtcaggagaggggagaggggtcagaagggaagcatgagagccccacttagcccattgtcatgggggggaagtcatggggagtggtcagcatggattccctctgagagccccagccaggggccttctgtcactgtgagtaaccaaattgtttttttgaccaagactttctggaccatgaagaaaaaaaaatccattgtcatttctgaaatcctggtcctggaaaccaatgaaatcacctgagcaaggactatgactctcatagaaaggaccccttaattctgatggtaatgtggatgctatggtggtgggagctttggcatcaggctcatatctaaagatgagtttataggagttctcatttttctcttcatgccttttgaatttggtaggcttgcctccctgaacccggggtatgttttcatcacaaaaagatttgaaaaacactatgatttctaattactggtgctttcctattattactgtgactgcaatgaccgccaatgctacttcatatgtattttatgggagtgaagtgaaataatgaatggaaagtgcctagcacagtgcctggcacatagttggcattcaaaaaacaggcctttccttctctgatgctcacctgcgtaaatgttgttcccatgtcctcaatacatacacttaactactttattttgaagttttgtgttttttctcattatcttctattgttacgatgaattttactcaggttcttgatctttcagttttcttggccaagtttctgagattttccatgcaacacactcgcatgcattattttttcctggctggttctactaatagaattttactcctaaggaaggtgatgtgctttttaaggtcactgtaaagagatgacatgaggtcaagtcttaccccttaattccctctcattagaatgtggcacccagaattcagccagagatggctttagtccaatttggaagccctccatgcttactttcctccttggagccaaagctacaaccatgggcatggcccctgttctttgtatacctgagggagtgctctgccccaaatctttctgctcccctcaatagcaacctattacacctgccatattcttactattgctcaactctaaattcaggccaccagaggttatcacccttgccaggtttctttggagaaatgacaatttgagatgctaccatctgccacatttacctgaattacctcaaattctggagactctgtttcccaaaagaagtcattgcttgggttgatttctgacaggttcctgcctagtagcagctgcccagcagaggccgtggtgggagcagtcagtccctggctttgagaaacaaaattccccaagggaactgcagaaccacactgtacctgaatccatcagcatacgaaggccgggtgtggcatgagatgtgcactgtgtaattgcttctttacctcctgcctgaaattgtctatcggaagctattaatagctatagtttattttccaaatctctttagggaaccaacatttatctcagacaggcagaaatcttaattgtggagtttttaagccagaagttccttggaagggaatataatccacatgcttatttagcaggtgaagatttagggatcccggaagtgaattagcttatccaaggtcatactaggcctgactagatgggttctgtggtctaggtgttcgtatctccctcttccaaattcgtatgttgccaccgaatccccaatgtgataattttaagaagcggggcttttaggaggtgattaagtcatgagggtggagcccttgtgaatgggatttgtgtccttataaaagaggcttgagggaccccctctgttcctgctgctacgtgagggcacatagaagctgccatgcatgaagaagaggccttcatcagacatggaacctgccaccaccttgatctttgacttttcagcctcaagaactatgatcaataaatttaggccaggctcagtggctcatgcctgtaataccagcacttttagaggcgaaagtgggcagattacttgaggtcaggagttcaagaccatactagccaacatggtgaaaccccatctctactaaaaatacaaaaatttgttgggcatggtggtgcacttctgtaatcccagctactcggggggcggaggcaggagaattgcttgaatctggggggcagaggttgcagtgagctgagattgtgccaatgctctatagcctgagtgacagagcaagactgtctcaaaaaacataataaaaataaaaataaataaacagtctaaggcattttgttatagcagtctgaagtgaagaagacaatggattttccaaccctggcctgacagagtgtagctactcagctcccttgtagcactggctgctgatttgtagacactgcactcttcttcgttttgcatgtctcctggagctttggggatgttcgcagtgcagccaccataaaaaccacttccaacctgaggaggaagacctgtgaacctgagtctggctgcattccatgaaaccaggctgctgttggagaatacaggagttttctgattctaaagatctttctaagagaaggtcttcttgtaacaatgatttatgccaaaacttaagagatgtggaatggagctggaattttttttaaaaattactgtgatgattagaatgaacgtggttcctgtcacatgctgagacctcagtttgggactgatgatgaagtggggagcagggcaaagctggggacattttaccacttataatgcacaagtcacaggccttctggccaaattgcagtgttttaaggagagtggcaaactttggcttcagctagattgaagcttttttccttttccagattcacaaatacttaattacttcaaactagctattctgcaagatacccacatgtgtgatatatctcttgtaatagttaccacaaacttgtgaactagacttaggttgacattctcgtacatatagtccagaaattcaagaagttatgaaaatggagagagagattatgtgtgtgtgtgtgtgtgtgtgtgtgtgtgtgtgtgtgtgtgtatttaacactaaattcatttggctgtcaaacctgacgcaaactgttatgaagctatctgtagcctttgtctcccatggtatgaattttgatatgcctcactgtggaaatatttgtgtgtctgagcccagaatgttgccccagatctcactaggactgttttatgggcccatattacttgtctaaaaacccaaactgttctgaattctgagctgtgtttgtcctgagtgttgtgatcagaaatgagggcatggattatcatctgtgttttaaaggtggggaaacagagcttcagagaggttaagtgatttgcccaaggatgttcagctgtgtaatagcacagcaaggtccagacaaatgcagattttaaaggagctttgactcattagtgggccttgttcctggtgagtggaatgtcggagctctgatgctacctaagaggaggcaagtaccaaacctgcagctggatggggtgggatatctgctttgtggctgagccccagctagcagtggggttttgaggggacagggtgtagcatacctctcatggcaagggtgcttgggaaatttagcaggctgtcagtagccttgccaaggagcctggtgttgaagactcagaagccaaaggccaagtgagccaaggcaaaaggctttgagtcaagtagcacgaaggactccatgaacaataaggagaaaggtagaggcttcttgagcaggaaggccactagggatctcccaaatatgtggggatgctgggctccaagtagcaactcatgctgtgagtatggcattcaggcaatgggcaggcagagtccacaggtcaaagctgaggggttgcaggaacaggcatttatacccattgttgtgagttgaattgtgtctctctaaaaaagatgtgatggctggacatggtggctcgtgcctgtaatcccagcactttgggaggccaagatgggcagatcacttgaggtcaagagtttgagaccagcctggccaacatggtgaaaccccgtctctactaaaattacaaaaattagctgagcttggtggtgcatgcctgtaatcccagctactagggaggctgacgcaggagaattgcttgaacccaggaggcggaggttgcagtgagccaagatcgcaccattgcactccagcctggacaacagagtgagactcagtgtcacacaccaaaaaaatgaaaataaaaataaaaaaacaaaaaagatgtgttgaagccttaaataccaatacctcagattgtgaccttatttggaaataccgtcattgcagatgtaattagttaagtcatactggagtaggttggccccaatcagtatctttgcaagaaggtgaccctgagatgacacagacacacatggagaaaaacatgtgacaacgcaggcagagatgggggtcacgcagctgtaaaccaagtaatgccagggattaccagcaaaccacgagaagttaggaggaggcaaggaaagattcttccctataggtttcagagggaacatggtcctgccaacaccatgctttcaggtttctggcccccaatagtatgaaacaataaatttctgcattaagtcacccagtttgtggtactgtgttacggcagctgaggaaaccaatatactagtaaacaacattaggccagggtatacaacctccactggcgttgggatctcctggggtttgtctaaaaagtctcattgtcctggctacaccccagtctaacttcattaggatctcagcgggtaaaccccagctattagaatttttaaagctcttcaggtgatttaaaaacaaatttgcaaaccacaacctagagtaccacttattaaagatcttaaacaagggatccagttcccagtagtaacagcaccagttggctttcacgaccctccagactatgccataccttgggatgtccttggtcatttttctccacccatgtttttctcttcactcttctcagcttttggccagcaggattcaagggaatcgctgctttcccttatttgtaaagcatgtaggaatatctggcacacagtgagtgctttctaagagtttgctgccattatttctccaactgcccttaaataaaaccctggctttcttaatcctcactttctggagggcaaccccagagtggtaggattttatcatgctggctcaaaaagccatttcttattatgcatgaaaactgtgccttactttcctttaattaaggctttttcttttctttttttccaatttgcctgagagctagatcatgtgaagggcgctttaaaaaaaaaaaaaaaacagagtgaacacagagtaagtgtgcccgagcttcagagtgacattgagagagctttttgctctgagactaaagaaagccatggatcagaatcctgcccaaggtgggaaaggctgatgggcaaccagggaggccgtgtgagatggaagtccctacgaggtatgcaagaagagcctacctccagcacctgtgcccttcttctgcccaacagatccctcctgcagagcccagaaagggatcatattgagccctggcctctaggaggtcatagtccagcaggggagatagatacttaaagtagccaatggcaagcagtgataggagatacatgagtcctgtttcctggaccaaccctggggaccaaaggtgtaggagcctcaagtctcatcatcccaagcccaagcacaggttcctatataaagggggcaaggactccccagaggttcccctaggaaggatgagcgggggacacggctgggcgggcagccaatgatggccactacactagacattggtgaaaaaatgggaaagggagattgtcaccaatttgtattggaatttggattccctgccatgagggagataccctccacagagaagtgggcacccatatcaggtttaaaatcagggaagggatgtgatttgtttttatatcccaacccttctgatcctctcctctgtccagcggcccattggttacagcccagatatcccaagataatggtgggatcacagagcaaggtcatggtgtagaccctttggtcagaagcccatacaatacagggatccccaactggtcctccaatgtccagtgtttcattgatctcaggaaagaaatctccagcttcccagatccccgttccagcctggctagctcagtctggagcctctgattaaaagggtacccagaggggcaagggctcataatatggtttgtccttagacaacagactggctttttatctgtggtttcattttatcaacagtttttgggctgagcgcagtgactcacatctgtaatcccaacactttgggaggctgaggcggatggatcacatgagttcaagacaagcctggccaacatggcgaaaccctgtctctactaaaaatacaaaaacagcagggcgtggtggtggacacttgtaatcccagctactcgggaggctgaggcaggagaatcgcttgaacccaggaggcagaagttgcagtgagccaagatcatgctactgcactccaacctgttcaacaagagcgaaactccgtctcaacaaacaaacaaacaaaacagtttacgtgagggcctggtactccaaagctgccacccagtttggaaaaagtgttcctttttccctcttacttctccgaaaggacagatggatatctgtctagggtgcaaatgtgaacaccaagagccacctttgacccctctttccctcagtccccaatcctatcccgttttcctcctaaatgtctgctgaaattattctattttctcctttgccaccaggataccatcatctctttcctggcagtcactcttcactggacttttgtttccctttggcctctgtactctgttctgcgtgtagcaactggactcttcgttgctaagcactggaataggctctgaggacccagcaatggataactcagatatggtccctgaataaatacatactgttaatgtagtgagtgttaaatgctaccaaggaaacaaatcacttgccttggtaggcatgagctgtttgagcagactggactgcagcagacctggctggatccaggggcccgagattggtccttccctccactttgatggcagggcatgggtggtgctcttggtcaccatggtggaggaaaagatgagctctcaagaggtgtggactagggcaggtgtcacaataggatgatagcctggtaagtgtgctgaggggtggcggaggccagatacctgctttcccagcagaagaccatgcccacatcagaacaaggtgaggggacctgtgagtgtcaggggttgtgggttgtctgaggcagcaaggtgctgggcccactcacagtggggatccaagggtcctccggatgggcctctgtgggctccagtggctgctggcatgaggaaagaactggagctgaatccagggcccacccccagctcctgtatgactgtgggacgcccacgtccctgctttgggccttgttctcccatctataatatgggcaggaagaaggagacagggctggttactgtccaccctcaagaagtgcctgtcattagggaaaccatgcggtgcggcagttaagtctggcctcagactgctggggttcaaatcccaactctggtgcttccttgctgagccacactggacacattaatctttctgtacctcaatttccttatttttgatatggggatggtagcacgtaatagttaatttctgaggattaaatgaacagtgaacataaaatacttagcacagtgccgttacatagcaagtgcccagtaaacacgacttattgtcatctaattatttgctaattattttagatagaaagtaggccttgttgttccagttttatggatgagaaatctgccaaaacgtgtctcagccagtgccaggaattcagtggccgattaaggattcaaacccagggctgtttggttccaaagctcggctcatccccttgtgttttgttgccatttctgacttgcagctctagaaaccaggtgttggcctgcgtccaggtcttagagctcagagacttgaatttcaagacagacctggcctttcttttcatattcaaatactctgcttggttccgcattgccaagcttgtaaggagtcatgaggatcagcttctaatctgggagggctttgcaggaaatagaaatgtccaagggttgccatttattcaacagctggaagtacacagaccaggtggtggcactgaagtctcagcagccatttatacctggtttcagggacttgtctcttgggaggtgggcagttgagagaacaaagaaactcccaggaatgtattgcagtggatggagggtctggggtgggaacatgcctggccctatgtgggaggcggggagaggaggggctcctggcacctaggcctgggcagcaggaggctagggtaacctgttcctggcaggttccttgattacaggcatctgaggtggatacagattcttggagtcaaattctagagctagggagaggtggctgaccccaagccctcatcttaccaatggaaaaattagaccaggggcaaacagaggggtttgcatcatccaaactcctccttcatgccaggcactgagctagtctccttcccaacgtgctatctcgtagaaacctttactctgtgccctgaaatccccactttctaaatgcagactgtcttcataataagacatggatatctattatgctttgcctgattaaagagaagggagaagtattttctgctcttaataactctctgtgtctgtatctctctcattctgctccctgttgattattaagatagaaaattgaggaaatataggaaattgtaaagaataaaatgaaaattatctataaacccagtaataaccaaaaataatcgttgttaataatttggtatcattcattctcttttttcttattttttgatgaaaaaaagttcttgtctagaacagttttaaaagtaatgtatgctacaaagccttgagtgaacagcagtagcccttcccctctcattctctgcccccctgaggcaaccagactcagctccttttgctgctgtttccccctgcgtttaatactacatttccaaataaaataggcattctgctagtccttttctatttcatttggatatcatctatctactgagttctctggaagcttccttgtacgtcctcacttacaaaccttcccaagtttccttttgaagtcccctcatattgtgattacatctctttcctcatttccccagtcatagagataatacctgccttgctttattattttgttttccttaaagtgtttccaactccccctcaaaagtgttaatctcatctccttgtgtctgaattcttcagaatatctattggtttcattgttttctctccttgaatttacatgcctagaagcctccagcttcctagtttaatatcgcctgtgttctctttagatcccagacacatcacttgttttggaatttcctgctacctctctcctttttctaggtcccatgagttctttttttgtgtggggtttactttctcattctattagagcatggtatataggagcttcctgagaaaagttatatttgaaggtaaaaaataatttaaatatcttgcctagcagataatcattttatgttatccttacatttgattgacagtttggctggatataaagttctggtaggctataattttttctcagaattatttttttaattgacatggagtaactttccctccttttggtacacatatatagttttatgggtttagacaaatgtgtagaatcatatatccattactctagtacatacagaagagattcagccctccaaagaaattaacatctgggaaaaggaaaaagggtggaggggtacggtgaattaaagaataaaagattgatcagattattggaagagaaaccccatcatatcccacaacctgaataacatttgcattgtttcggatttttggtgattatgaataaatccactgtaaatgtcagcataccggtttttgtctcaatgcaagtttttatttcttttcagtaaatactaagatttctgagctgtacgataaatgtatatttgacttcataaggaactgtcaatctgtttttcaaaatggttgtaccattttgcatactcatgagcaataggtgaggattcaatttgttccacgtcctcacctgcagttagcattttttttcctttttcccctttgttttaaattttagctcccctaacaaaatgtgcagttgtgtcttattgtgattttaatttggattcccctaatgagtaatgatgttgaacatcttttcatattcttatttgctttctgtacatcttctttagtaatgtgtttgctcaaattttttgcccgtttaaaaaattgagctgttattaagctttgagagttctttatatatccaaatataagcattttgtcagatctgggatttttaatttttttttcccagcctatggcttgtctttttattctcttaccagtatcttttacagagcaaaatattttaatttcgatgaagtctaacatcagttttttacttttatggatgatgacactaagacgtgtcttatttaacaatttttagcctagtccaaggccacaaagattttttcctgtttttgattttatattttacatttaggtttatgttccattttgagtaaacttttacatatagtgagaggtataggtcaagggtcctcctttcttccccccgctccgtgtgaatgtctaattgttctggtactatttgttgaaaagcctgtcctttctccactgaattatctttctaactttgtcaatccctcagaatttcacagatgttggctgtgttgtcttctgatttcccttcacaatattgagaagtccagtgccattctgattccttatcttttatatgagacatatgtctgcttttatcttgtaaatgtttagtctttttttccttaaatgagatggggcctcgctttgtcatctagtgtggagtgcagagatgtgatcatagctcactgcatccttgagctcctgggctcaatcaatccatcctcctgcctcagccttctgagtagctgagactataggcacatgccccactttatttattttatttatttatttattttttcagagatggggggtctcgctatgttatccaggctgctctcaaattcttgggctcaggcgatcctcttgtctcagcctctcatagtgttggcatttacaagcatgaaccttcatgcttggccaagttttttttttttttcttttaatttcagtgttttgaggtttcataatgactttaggtttttttttaagttatactgcatgactatttggttactatttcaatttacaactttgttatcatcagttctagaaattattcttaaatcatttctttgataacatattctcagttttctctcgtatatttttttctttctttggcacggggtctcactgtgttgtccaggttggagtgtagtggtgcagccaaggctgactgcaacctctgcctcctgtgttcaagcaatcctcccacctcagcctcctgagtagctgggactacatacacatggctaaatttttaatatttttgtagagacacagttttttattgcccaggctgatctcaaactcctcggctcaaacaatcctcccacctctgtctcccgaagtactgagattacatgtgtgaggcaccaagcctggccttttttttttttttttttttaacaaatcctattagttggcttttggattacataagccaaaactcaattttcttgtttttttttctttgcttttccttcttcttcttctttttttttttttctttctgtattctggacaatatcctcaacttcatcttctaagccatctattgcaatttttatttatacttgtatagttttaacatctgatagttatcttggttcttggaatgatccttttttacagcatctttttcttggataaaatctcttctctctacattaaaaaatgctcttcaaaatgtctttttttttagcttttagtttcaggagtatgtgtgcaggtttgttatataggaagattcgtgttgtggggtttgattattttgttacccaggtcctaagctcagtacccaatagttaattttttctgatcccctccctcctctccctctccaccctcaagtaagccacagggcctgttgttcccctctttgtgtccatgtgttctcatcatttagctcccacttataagtgagaacatgtggtgtttggttttctgtttctgcattagtttgcttagaatacagctccatccatattcctgcaagacatgatctcattcatttttatggctacattgtattccatggtgtatatgtaccacattttcttcatccaatctagggcacttaggttgatttcatgtctttgctattgtgaatagtgctgccatgaacattcatgtgcatgtgtctttatggtagaatgatttatattcctttgggtgtatacccagtaatgggactgctgggtcgaatgatagttctctttttagctctttgaggaatcaccacattgttttccaaaatggctgaactaatttacactctcaccgacggtgtgcaagcattcccttttctctgcaaccttgccagcatctgttatttttttgacttttaataatagccattcttactggtgtgagatggtatctcattgtggtttttatttgcatcatttctctaatgatcagtgataatgagtttttcttcatgtgcttgttggatgcatgtatgtcttcttttgaagtgtctgttcatgtcctttgcccactttctaatgggattgtttttctctcataaatgtgtttaagttccttatagatgctggatattatactgttgtcagatgcatagtttgccaacattttctcgcattatgtaggttgtctgtttactctgttgatagtttattttgctgtgcagaagctgttaagtttaattagatcccatttctccatttttgcttttattgcaatcacttttggtatctttgtcatgaaatctttgctgttcctatgtacagaatgtccctatgcctaggttgtcttctagggtttttatagtttggggctttacatttaagtctttaattcatcttgagttgatttttgtatagggtataaggaaatggtccagtttcaatcttctatatatggctagccagttatcccagtaccatttattgaacagggagtcctttccccattgcttgtttttatcagccttgtcaaaatcagatggttgtaggtgtggggccttacttctgggctttctattacgtttcattggtctatagatctgttttggtacctataccgtgctgttttatttactgtagccctgtagtatggtttgaaggcagctaatatgatacctccagctttgttgtttttgcttagaattgccttcgctattcaggcccttttggttccatatgaatattaaaatagatttttctagttctgtgaagaacatcactggtagtttggtagattctgtaggttgctttgggcagtgtggccattttaatgatttaattcttcctatcatgagcatggagtgtttttccatttgtttgtttcatctctgatttattcgagcagtgtttcataattctcattgtagagatctttcacctccctggttagctgtattcctaggtattttattctttttgtggcaattgtgaatggtattgtgcttctgatttggcactcagcttggctgttgttggtgtatagaaatgctagtgattttcatacactgattttgtatcctgatttatatagatataaaatcatgttgtatgcaaacagggggagtttgacttcctatcttactatttggatgccctttatttcttcctcttggcttattgctttggccagggcttccaatgctatgttgaataggagtggtgagagagagcatccctgttgtgtactggttttaatgggaatgcttccagcttttccccattccatatgatgttggctgtgtgtttgtcatagatggctcttactattttgagatatgttctttgaatacgtagtgtattgaaagtttttaacatgaagcgatattgaattttattgaaagcctcgtctgcatctatagagataatcatgtggcttttgtctttagttctgtttgtgtgatgaatcacgtttattgatttgcacatgttgaaccaaccacttgcatccttgcaatgaagccaacttgatcatggtagattagtttgtgatgttttgctggatttggtttgcaagtattttgctgagaatttttgcattaatgttcttcaaggatattggcctgaagtttctttttttgttgtgtctctgccaggtttttgtatcaggatgatgttggcctcatggaatgagttggggaggagtctatcctcctcaattttttggaatagtttcggtaggaagggtaccagatcttcattgtacatctggtagtattcagctgtgaatccttctggtcctgggcttgttttgattggtagactatttattaccaattcaatttcagagctcattattggtctgttcgggaataaacttcttcctggttcagtctttggaaggtgtatatgtccacaaatgtgttcagctcttctaggttttctagtttgtgggcatagaggtgttcatggtagtttctaaggataatttttatttctgtggagtcaatggtaatatcccctctgtcatttctaattggatttatttggttctactctctcttcttgtttatttattagtctattttattaactttttcaaaaaaccaactcctggattcattgatcttttgaatgtttttcatgcctccatttccttcagttcagctctgattacaggcatgtgccacccacaaccagctaattttgtatttttagtagagatggggtttcaccatgttggtcaggctggttttgaactcctgacctcaggtgatccacccaccttggcctctcaaagtgctgggattgctggtgtgagccactgcgcctggccaatcatggccttctaacagtcccccaaagtcttatctcattccagcattaactcaatagtccaagtccagagttttgtctgagatgaggtgagtcccttccacctatgagcctgtaaaatcaaaagtaaattagttacttcccagatacagtggaggtacgggcattgggtaaatacacccattccaaatgggagatgttggccaaaacaaaggggctacaggccccatgcaaatctagaatcaggcagtaattaaatcttaaagctccaaaataatctactttgactccgtgtctcacatacaggtcatgctgatggaagagatgggtgcccatggccttgggcagcttggtccctatggctttgcatggtatagccccccttctggatgctttcatgggcttgtgtggagtgcctgtgatttttccaggcacatggtgcaagctgtcagtggatctaacattctggggtctggaggactgtggccctcttctcacagctccactaggtagtgccccagtggagattctgtatggagactctaaccccacatttcccttctgcactgtcctagcagaggttctctatgagggctccactactgcagcaaacttctacctggacatccaggtgtttccatatatcctttgaaatctaggtggaggtttccaagcctcaattcttaacttatgtgcaccctcaggctcaacaccacatggaagctgctagggcacaggacttgcaccctcttaagccatagcctgagctgtaccttggcccattttagccatgactggagtggctgggattcaggacacgaagttcctaggctgcccacagcaggggtccctgggcctggcccacaaagccatttttcttcctagtcctctgggggaggggctactgtgaaggtctttcacgtgccctggagacattttcccccttgtcttggtgattaacattcggctcctcattactaatgcaaatttctgcagcaggcttggatttctccccagaaaatgggtttttcttttctattgcattgtcagctgcaaattttagaaatttttattttctgcttcctcttgaatgctttgccacttagaaattttttctaccggataccctaaattatctctctcagtttcaaagttccatacatctctagggcaggggcaaaatgccaccagtctctttgctaaagcataacaaaagtcacgtttgctccacttcccaacaagttcctcatctccatctgagaccatctcaacctggacttcattgttcatatgactatcagcattctggtcaaagtaattcaacaagtctctaggatattctgcactttcccagattttcctgtcatcttctaaatcctccaaactgttccaatctctgcctgttacccagttccaaagtagcttccacatttttggacatccttatagcagcaccctactctactggtatcaaattactgtattagtccattctcacactgctgataaggacatacaagagactgggtaatttataaagcaaagatgtttagttgactcaccgttcagcatggctggggatgcctcaggaaacttataataatggcggaaggggaagcaaacatgtcctttttcaaatggtgacattaaggagaagtgccaagaaaaagggggccatctcctttaaaaccatcagatctcttgagaactcacacactattatgagaatggcagcatataggtaaccaccaccatgatttaattacctcccaccaggtccctcccatgacatgtggggattatgagaactacaattcacaatgagatttgggtggggacacagccaaaccacataagggcatttatagtgctatagatttccctcttaacactgccttagctgtatcccagagattctggtatgttgtatctttgttctcattagtttcaaacaacttcttgatgtctgccttaatttcttttttttatccaaaacttattcaggggcatattgtttaattttcatgaaattgcatggttttgagcaatgtttttagtgttgacttctatttttattgcactgtgatctaagagtgtgtttggaatgattgtggttcttttgcattttctgaggattgttttatgtcatattgtgttcacttttaaagtatgtgccatgtggtgatgagaagaatgtatattctgttgttttggggtagagagttctgtagaggtctatcagatccatctggtccaatgttgagttaaagtcctagataattttgttaattttctacctcaatgatctgtctgatactctcagtggggagtctcccactattattgtgtggaacttgaaatctccttgtaggtctctaagaacttagttcatgaatctaggtgctcctgtgttgggtgtgtatatatttagggttaggttaggtcttctttttgaattgaatcctttacaattatgtaatggccttccttgtcttttttgatctttggctggataaagtctgtgttgtctgaaatgagggttgcaacccctgctttttctaatttctatttgcttggtagattttcctcatccctttattttgagcttttgtgtgccattcattgcatgtgagatgggtctcttgaagattgcataccatttggtcttgcttttttatccagcttgctaccctgtgccttttaagtggaacatttagcccatttacattcaaagttaatactgatatgtgtgaatttgatcttgccattttgttgttagttggttatcatgccagcttgtttgtgtggttgctttatcgtgtcactgctctgcatatgaaactgataagaagagatactacatttgatcttagccaaaaggctgagaagcacttatcttttgttttctacctgcacttttcccctccctgtttgttttggtctcttctgttcatgttagagatttaactcaaatagtcatcatcattggctatccattcatatttaagagattggcactaaaattttgagtctatgtattgcatgggaggggctttgttcactgacaggtttgactatatggaaataagacagtaaactggatttttatggatgaacattggaatgttcacggctaaggccttttcctctccatctggtaaatttttccaaagataagccttctgcactcatgaaggcatgggaagtatgtgtaacctggctgtgggtactcagagctaattgggggatgctgtcttcactcagtatgttggtttcagtggatcacccgtggttttgcctggtgacttaccccctctcagctggccacagaatccttgaagctatatcctctctgcttgatatgttgtagtaactacattttcagtcttatgtaggtattgagaagggactggcatctggtcgcatggcagatgtcaaagggggttttgtgggtggttgtcttaacatttcttatacagattttcaggtaattttgttttcagccctaggtgttcctgccgttagaataatctggttgccccatttctgggtccttttggtactccatgggttaaattggttgtattctgctttcttacctgatggacatacgggcttcagttttcactgctctgcttaatcagttaccatttgtccaaccatttttcttcctccaaaatgtttgcatctctcaattgctgtcacttttttccccattctcttggtatatatgggtttgtttatgtctttttaattcctacactgtcattttggtgcatttggaagaaaatggaggttaatgcatgtgtttactttgtgatgtttaattgaaagttgaactcttctcaagtcgtttttctatatgtagattactatttatatacacacatgtgtatgcatatgctcatacgtttgctaaatgtatatatatattttacaaaattaggtgcaagctataagtcctgttacatggcttttttttctcatttagaattctatcattaacatttttatgtcattaaatattcttgaatgcttggacttttacatcaattaaattatatcatattgccatattattacttatttaattacgtccttacacttgggtgttgaaattgctttcagtctttcagtacagtaatactgtcgtgagatttttcacctaaatatttgttatgatttctcattatgtcttctagattgggattattcaattggtggtgtgggcattttaatgtgatatgtgattcatattgtgttatatgattcacaacttgataatgtgatacgtattatcaaattgctcctcagaaaatcattgagacaactggtagtccaagcatcaggtaattactcatttactatttgctaatattaggaattatcactgtttcaaaatcttagcttatttgataagaaatgacactgcatcctattgacctggtttttccttattatatagccaaatatattttatgttttgtcctctgtgaattatctgttcataaacatttttatattttccatatatgtatattataagcttttttatggagaaaggatattattctttacctggtacttacattttttcagtttttatttgctttcagaatttttgatgtctctgatgaatagttttaatttttatgttgtccattatagaaaactttatatcttcttttgcttttgaacttcaaaagttatttccctattcccaaatgagataaatattctcttgtatttttctagattttaatgatttgattttttattcttcttcatgttcaactctttatagttatgaattaattaattagctagttaattaatttttcattcaccatgtgaatagaatctaagtccattgttttttcaaatactatagttaatcagtattccagaaccatgaattaatagtttagcctttctcccctcattaaaagtggggctgttctcatcaaatgcattctcatatatggtctattgatgttctttcttcttcttgtcattagcctgtctgtttttatgtcagtacaacactcttttaattattgtggctttactaggtatttaattcttaataggacattctcttctagttacactttatgaaaaaaaacaaaacaaaacaaaagagagagagactctttgtgtctcctttcaaatgatctttagaattattttgccaagttccagaaaactcctcttgggttttattcgaattgaaaatattgctcaaattatttttgtgataatttccatcttgactttattgagtcttcagactcagaatcgttacctgtatcttcacattttcaaggattcttttatttccctcagtaaagttttgtgggtttcttcatctggacctctcatatctctgtttaagttgattcctagttatttgctaccatgggatttaatttatttcttgtcagagcttccaagtggttattgatgctatataagaaagctgttgtgttttatctatttgttttttaaccactcatcttactgaacttttttttttaatcagtactgcaagtttttgagttgatgcttgtgttttttttaggtattcaatcatatcatcaggaaaataatggtaattttatctcttgcttttctattattataaaaaatttctttctttctaacttcttccttctctttcttcccttttaattttattgcttagagtttgcaaatcaatattgaataatgtaagtataaccttgtttcattcctgaatttaatagaagtggcttcagtgtttgactcttatatatgatgttgtctttggcttcagatgggcgctgttattctaatagagtattcttctacatctaaaatactgactttttttgaggaggatgtgagtaataaactttttttttaatttcatttttacattttgtttattctaaaaaaaggaagaaatgggatacatgtgcacaatatgcaggtttgttacatgagtatatgtgtgccatggtggtttgctgtgcctattgacccatcctctaagttccctcccctcaccctgccacccctcaacaggccctggtgtgtgttattcccctctgtgtgtccatgtattctcagtgttcaactcccacttataagtgagaacatgcggtgtttggttttctgttcctctgttagtttgctgaggatgctggcttccagcttcatccatgtccctgcaaagcacatgatctcattcctttttatggctgcatagtattccatggtatatatttaccacattttctttatccggtctatcattgatggggatttgggttggctccatgtctttgctattgtaaatagtgctgcactaaacatacatgtgcatgtgtctttatagtagaatgatttgcgttcctctgggtatatacccagtaatgggattgctgggtcaaatggtatttctggctctagatccttgaggaattgccatactgttttcaacaatggttgttacattcctaccaacagtgtaaaatcatttacatttctccacagtctcactagcatctattgttttctgactttttaataatcaccattctgactggcatgagatggtatctcattatggttttgatttgcatttctttgatgatcagtgatgttgagctttttttcatgtttgttggctgcgtaaatgtcttcgtttgagaagtgtctgttcatatcctttgccactttttgatgggttgtttttttcttgtaaatatgtttaagttccttgtaacttgtggatattagatttttgtcagatgggtagattgcaaaaattttctcccattctgtaggttgcctgttcactctgatgctagtttcttttgctgtgcaggagctctttagtttagttagatctcattggtcaattttggcctttgttgcaattgcttttggcatttttgtcatgaagtctttgcccatgcctatgtcctgaatggtattgcctaggttttcttctgagatttttatggttttgggttttacatttaagtctttaatctatcttgagataatttttctataaggtataaggaagtggtccactttctgtttttgcatttggctaggcagttatcccagcaccatttacttaataggatgtcctttccccattgcttgtttttgtcaggtttgttgaagatcagatggttgtagatgtgtggtgttatttctgaggtctctattctgttccattggtctgtatatctgttttggtacaggtaccatgctgttttggttgctgtatccttgtagtatagtttaaagtcaagtagtttgatgcctccagctttgttttgtttgcttaggattgtcttggggtcttctttgattccatatgaaatttaaaactattttttctaattctgtgagtaatgtcaatggtagtttgatgggagcagtgttgaatctgtaaattactttgggcattatggccattttcacagtattgattcttcctatccatgaggatggaatgtttttccatttgtttgtgtcctcttatttcattgagaagtggtttgtagttctccttgaagagatctttcacatcccttgttagctgtattcctaggtgttttattatctttgtagcaattgtgaatgggagttcattcatgatttggctctctgcttgcctattgtcagtgtaaaggaatgcttgtgatatttgcacattgcttttgtatcccgagactttgctgaagttgcttatcagttcaaggagttttgtggctgagatggtggggttttctatacataaaatcatgttgtctgcaaacagagacaacttgacttcctgtcttcctattttaataccctttatttcttcctcttgcctggtaaccctggccagaacttccaatactgtgttgaataggagtggtgagaggaggcatccttgtctgtaccagttttcaaagggaatgcttccagcttttgcccgttcaataagatattggctgtgggtttgtcataaatagctcttatcattttgagatatgttccatcactaccaaggttattgagagtttttaacaagaagggatgttgaattttatcaaaggccttttctgtacctattgagataatcatgtggtttttgtctttggttctgtttatgtgatggattacatttattgatttgtgtatgttgaaccagccttgcatctcagggatgaagccaacttgatcatggtggatatgttttttgatgtgctgctggatttggtttgtcagtattttactgaggattttcacattgatgtttatcagggatattggcctgaagttttccttttttgttgtgtcttcctggttttggtatcaggatgatgttggcttcataaaatgagttagggaggagtccctccttttcaattgtttggaatagtttcagaaggaatggtaccagctcctgtttgcatttcaggtagagttcagctgtgaatctgtctactcctgagccttttttggttggtagcccattaattactgcctcaatttcagaacttgttattggtccattcagggttttgactttttcctggtttagtcttggttgagtgtatgcgtccaggaatttatcaatttcttctagattttctagtttatttacgtgaggtttttatagtattctctgatggcagtttgtatttctgtgggatcagtggtaatatcccctttatcattttttattgtgtttatttgattcttctttctcctcttctttattagtctaactagtgatatattttgttaattttttcgaaaaaccatcttctgcattgttgattatttggagatttttttatgtctctatctccttcaattcttctctgatcttagttatttgttgtcttctgctagcttttggattagtttgctcttgcctctctaggtattttaattgtgatgttaggatatcaatttgatatcttcctagcattctgatgtgggcatttagtgctataaatttccctcttaacactgctttagctgtgtcccagagattctggcatgctgtctccttgttctcattggtttcaaagaacttcttgatttctgccttaatttcattatttacccaggagtcattcaggagcaggttgttcaatttccatgtaattgtgtggttttcagtgagtttcttaatcctgagttctaatttgattgccctgtggtctgagagactgtttgttatcattttagttcttttgcatttcctagggagtgttttacttccaattatttggttgatttagcataagtgccatgtggcactgagaagaatgcatattctgttgattttggtgtagagaattctatagacgtctactaggtccacttgatccagagctgagttcaactcctgaatatccttgttaattttctgtctcattgatctgtctaatattgagagtgaggtattaaagtctcccaatattattgtgtgggaatctgagtctctttgtaggtctctaagattgtcttatgaatctgggtgctcctgtattgggtgcatatatatttagaatagttagctcttcttgttgaattgttccctttaccattatgtaatgcctttctttgtcttttttgatctttgtttaaagtcttttttatcagagattaggattgcaacccctgcttttttatttttttttatttttatttttattttgctttccatttgcctagattttcctccgtctcattattttgagcccatgtatgtctttgcatgtaagttgggtctcctgaatacagcacaccaatgcctcttgactccttatccattttgccagtctgtgtcttttaattggggcattcagctcatttacatttaaggttagtattgttatatgtgaatttgatcctgtcatcatgatgctatttggttattttgcacactagttgatgcagttcctccatagtttcattggtctttatattttagtatgtttttgcagtggctagtacctgtttttccattccacattcagtgcttctttcaggatctcttggatggcaggcctggtggtaacaaaatccctcagcatttgcttgtctgggaaggattttatatctcctttacttatcacgattagtttggctgcatatgaaattctgagttgaaaattcttttctttaagaatattgaatattggcccccaatctcttctggcctctggagtttctgcccagaggtccactgttagtctgatgggcttccctttgtaggtgacctggcctttctctctgtctgcccttaatagtttttccttcattttgaccttggagaatctgatgactgtgtgtcttggagttgatcttgttggagagtatcttaatggtttctttgcatttcctgaatttgtatgttggcctgccttgctaggttggggcagttctcctggataatatcctgaagtgtgttttccagcttgtttccactctccccatctctttctgctacttcagtcaattgtaggttcagtctttttatgaagccctgtatttcttggaggctttgttcattccttttccttcttttctcctctattcttgtctgcatatcttattttagtaaggtgatcttcaaactctgatatcctttcttccgcgtggtcagtttggctgttgatgcttgtgtatgcttcacaaagttctcgtgctgtgtttttcagctccatcaggtaatttatgttcctcagctccatcaggtaatttatgttcctctctaaactggttattctagttagcaattcctgtaaccttttatcaaggttcttagcttatttgcattgggttagaacttagtttttcattacccatcttctgaggcctacttctgtcaattcatctgtctgatcctccatccagttttatgcttgtgatggaacgacgttgcagtcgtttggaggaggagaggcactctggccttttgtgttttcagcatttttttgttgattctttctcatattcgtgagtttgtttagttttcgtttttgaggctgctgacccttgaatgggttttttttttgggtctttttgttgttgttgttgttgatgctgttgttgtcactttctgcttctttatttttatttcaatagtcaggtccctcttcattagggcttctgcagtttgctgggggttcactttaggacctagtcatctgatttgctcctgtgcctggagatgtcactcaaggaggctggggagcagcaaagatgggtgcctgctcgttcttctggggcctctgacctcgaggggcaccagactgatgccagtagggttgctcctgtatagggtatctgacaacccctgttggaggggctcacccagttgggtggcacggggatcaggacccatttaatgaaacactttgtcacttggtggagagggtgtgctttgctggggggaaacctacttgtctgggctgcctggattcctcagagctaccaggaagagagactaagtctgctggtccctagaaactgtggctgcccctcccgccggggctcaggtccagggggatccgaattctgtccttgagcctctagctggagttattggagtttctgcagggaagccctgcccaatgaggaaggataggtcagggttaggcctgaagaggcacgctggcctcagactgccacagccagtgtgttgggctgtggggacaaatcttgggatcaagccctccagcctccctggctccagcataaaatactgactttcttaaagccaaaaatattgaaaagattttaccaaaagcctcttccgcaacaatggattagagattgtttttctcacctcatcctgctgaaatcataacaaaaggcattttatattttcaaacagtctttcctttcctagaataagcatactgtccctgaatatacatatatttctttttcatatcacaatttaatttaattcagggagtattattgtgtacacattgataggtgagattgttctatagttttatgtttaatttcattttcaaagatctgttaaaccaaaaaaaaaaaaaaaaccaaacatgattaagatgtcaaataactcagaagggttcatgtttaaaaaccaccatatgctgtttggcttctctgcctttcagatcccgccctcacaggtcatccatttctatttttgcttctttggtggttatttctacatgtgtaagtagtttacttaaagtgcttttcttgacttattaacttaatatgttgtctactggctttctgctaagaaaaatgaggaattgcccttttaaatcactttctagcttctgttatagtaaatgtttactttttatgtctaccactggtaatctttgcaaattcagatgctatagtttacttcagcctctgcttcttgttctaggaaccatcagggtcttctgggtaaggtgaggaagacattgttgatctccccttctcccaatcacctctgtctttgacattgtcatccttgtttttacgctttcatggccaaggttggtaatttttaggcttttctccataacgattcttgcctttcatgattggttagtgtattagctcattttcacactgctgtaaagaacttccctgaggctaggtagttacaaaggaaagaggtttaattgactcaagttccacaggcttaacaggaagcatggcttggaggcctcaggaaacttacaatcatggcagaaggcgagggggaagcaggcaccttcttaccagggcggcatgagggagtgtgactgtgcaagaaaaaactgccacttttaaaaccatcacatctcatgagaattcactcactatcatgagaacagcatgggggaaacctccctctgatccagtcacctcccttcctcgacatgtggggattacaggtccctccttctacatgtagggattgcaattcaagatgagatttgggtggggatacagagccaaaccatatcagtcagtttaatgattctaaaagttgaaagtggatacatagctcttccattattcttactgtgtaaattgtttcattgcaaaaccaaaccgtgtgctaggatcatatttccttttctgctggactcgagcatatcttctctacctctcaaaggagaatgctcctacctttaaggttgaagggattctctcttttacttacaccccactacttacttttatcatagcatctgagctatcaacttctcttatttcatgagagatcttactcacttccagagccacctgtcctactgttccaatcttcactgaatattaatcatggctgtcgtctgagatgaggtggcttttcacagttagtattactggcttcagcccaagaaagaagacttttgtgtgtgtgccagctcccagcctgaaagtttcctccagactcatttttgtagatgttcataaccctgatattaaaatgaaatgaaaaaaagagaaaaaaaaagttttctgttcaaacaggactacattctcatataatttcccaagaaagagtaagtagtcttgtgtggctcaaaatgtctgggtctaatttatttgatagttttgctgggtatacaatttttgactaaagatcactcttaaaaatttgaagttatggtgacatttctccccaggatccaaagtggttgatgagaagccctgtcaactcagcctctctcttgccctgattgtttttgtgagcctaaacacttttaaaaatccacttatgatcatttcagagaggccctagaagacaaatatcagtgatcattttgctttttttgactgaaaatatttatttttgtacctttttaattttatcttaatatcaggcttggatgaacctcctaaggtgcgttaggaagcagatgacaacttctaagtttgacctggcagaaaaaatgtttccttgttgtgctgaagcaaatgttgtaaacttactttgctactggtttcctttgccatgtatcagaacctctgattttcaccatggtttgagctttgcctccatccttggtgttggcaatccctttagctttaaactcatctcttcagtcagtcatctgacaaacgctaagctccttcagctcagccctctaccacactctatcccccctaccccagtgctgtgtttgaacataagaggacacaattgaccaacataaataattcagtagatcccatactctttagcttctgcaaatgaacatgctatgtctgcttggtctttactaagatctaaatgaattcaggactaagcctttcaaaaacctactacaaaaacatcagtgaatagtataaactttaataaatattccttgtgtgagatggagaaagtatacctttcagaggaaacaactgaaaattaatatcagaccatctttttttcaatgttcattctcacctgtacccccattgcttttacttaactcttcatttttcttactcagcatttggtctagcttgttctatctcttttctctcttctgttgtacttttttcccctctgttatggaaggcaattaggttttgcttctgggttcttcccacaagcttgcgtgtttaaactaatgttggtgttcagcaaaataggggccttctgattgaaaaaaccttccttctgagaagtgaataaaaatatttcttctaacacatgaagtttatctgcaaggagaattcttatgaatgacatgcttgccatcaattataaccacagaattcttgtgtcacccacctcctgatgaaacatggcactaaagatggcagtcatgacatttgcttcctttataaaataaatggaatgtgctacgtgattcctaggactgatttaagtgctaacattttataatcctataaattagataactaagttcattactgcagagtaataacagctcattcattcataactacatttattgaaaacatattcttcatataaaatttgagagcttgcaaagcaatttacatatattatctaacttagtacttctaaaaaaattcatgagttcagtattataattattatcccaacttacttatggaaagtgtgactcagatatttgcgttaagatcactgacagaaactgaattacagaattcctcttgacaaatacgtaatagattgagcaaacaagaatacaagaaaagaaaaataaataaaattcaccacaacaccaaaacaagggaaagaaaactatcaaatgcaagttttaaacactggtaagtatggaaagaaacaggagacacagagtgatgtggagaggtatagctaggcttctaaatctttttccccacccaccaaaaagcatattagtaacatagtttggggattcctcaataccaaacatctagagaaaatcaagtttactgggtatcattatcctttctctcatatgattaagtaataagaaaaaatggcttggggccgggatgggggtataaacaaagcaaaggaagggggttatggaggaggttaactttctctaatggtagcaaaatcttcaggactgtcttctaaattgagtaagataaatgaaaatagggactaccttctcatcagaaaagtaaatacctgcaagtagatgtagtgaatctgagtatgggatattcacaaaatctaaaaagaagaaacagatgcccagtaatctaagaatgaccaaatatcaccttagatgagctctctccttccttctcactgtttcattaggctcagaaatcagacagaataaagaatactcaatcttcaaacttcaaggggaaaacaaacttccctgatatggtaggaagaaagtcaggtgtcacatatgctatatatcatagcaaatggcatgtcaggatggagccacccgagtggagtcacctaggcagaacaagaaggtaagaaatgtcatggcaacattaaagcataccacaaatactaattttgaaaaaaataaagggaggaagagaaaagaaacaaggaaggaaagaaggaaaagagggagggaggaagagaggaagggagggggcaaggaaggaaggaagaaaaaggaaggaagggatgcaagcaagcagggggctgtaatatacaagggcaaggattctaacctaaaaaaataacatttcagaaacagaggtaaattattcacaattgcttcattctatagaacaatttgatatgaacaccaggtcaataaagcgagggttcaggataatggaataaatggacagcatgagattaatagggacaaaaggaaacaaattgaggcccaaaatagcattaataggattaaagagcccataaataatgacagcaaaaagtgaaacaatacaaaaacaaaatagaatatacattgctggaaaaaacagtgtagagggaagtcttaacaagcacatgaatacagatgaaatagagtggtgaaagtagtcaactgaatatgaacataaagaaagctaaaggagaaagcaatttattctacaatagatacagacataaagatatatactctaaaggtataaacatataaccttttatttattcaaatataacaaaatatagcttagtataacaacaataacaaattattttggcgttgattatgcatgaaacatttatttagaggtttacatgaattaatttttcacaacaatttgaggttaatacaattagtattcccaatttatagatgaggaaattaagatatagttacgtaacttgcccaaggcaacatgtctagtatatataacagaattgggattcaaaagagtagaatgatgctattttgcctctggataaaaaaaaaatcctgaagcgaataaataactgaatgtgcaaatcaaaagagaatgtgttacaagcagctgaaccattttacctactcaccagcagtgtataaggattccagttgctccatatcctcccaaaaattgttactgttcatttttggactacaggattccatttataagtaatatctagagtacgcaaattcatagagatagaaagtagattagaggttaccagactggggcaggagagaatgaagagttattacttaatggttacaaaatttctctttggggtgatgaaaaagttttagaaataaataatggtgatggttccaaaatattgtgagagtaattaatgctgccgaattgtacacttaaaataattaaaatgctaaattttatgttacatattgtagtaaaataataataaagagacaatgtattccaggaaaatttggtacagaatgctagataccaagacataccctagttaaactattaaaacttaggataaatacagaattacccagtattctagacacaagaatatcctccacaaggagaaaaaaaaaagtcaagttgtcctcagacttctctacagcaggattcaatgtcaaagatgaaagaatggttatctaaaagatttgagggaaagaaagcatagttcaagaatataatagaatataaagctcacaagtcatggttgtcaagagtaaatgtactcaggcagtgtaatatccataagatcttgacaaaaatacttaattacaaaatacaactaattaaaagcaaacaaaaataaaagattcatgaatgcagacctcataacataaggattgatgataagtaatgaaaccatataaatataggactcacagtaagcaacttagacaattacagttatagatcagggtatgaaggttaaaacctgggcagtgtaacaacagcggccaccaacaattaaaactgagaaattgagagagggaggagaagttgaggggaagtgtgatagttctaataccatatttgacagcatggagtcattagataagcttaacatcaaaataaatagttaaaatatagtataattacttcaagctcttaatgctttcttcacaatctgtgttcttaaagagatctttgggtaagtatctcttggtaaagaagtatttgaaaggctagttttctttcaattttgttttaatttctttttcttctgctacatacaagtaaagacaaatacagtgttaaaaaaaaacttaaagtgacatatattttatcccacatttcatagtatttatttccacctattcttccgtccatccgcccatcctcatccatccatccgtctgtccttttgtctctgtgtatatcataagatatttaaaatgatgtttgccatatgttaatgacagttatttctgggtagtgaaacttaagattttttttaaacttcaatctttgtattttgcatttcttgaattcctcaaaatgaatatgtatcatttcccaataacaataaagtaatctttcttctttaaaaataaaaagggaaagcaaatatgttaagatgttcacagtggttgaagctagatggcagagttatgggtatttataattttattctttgtagctttctcaattttctgccacttttaatttattaaaatttaaagagcataaaaggaaaacaaatgaagtacaaaggggcttgttctaagttatatagtcagaaagtgattgtgcaatgatttaaacctaaatagaaggacaggaattaagacctggggcgggttggacgggcaaaggggagaggcagcgtcgaaagacttctatggtggaagtaatctagtttttccaccatgtggaagtgatctgattttccccttttgggtgggaacagtgtttcagttgctgggaaagttacttgcagtgaatctgatgcccacagtattgtaggaatcctaaatccacaggaatctggaaatccttccatccaacctgtacttgaacagatgaaggactatagacaccaggtattattttatacaatggtaagcttcagaactgcgtactgcttttaaggcaatctagtgcaatcctaaatgcaaactgagctttgtgttacgctgcatgaactaggagtctccaggtcctgaccagaccagtcccatagccgtggggtgagagctgattcagattcaatagatatttaattcaggcttcccttgtgtgtataagtgggccggggctttgacttgttctgtcttatgtaatcaccccaacatccaggtaggtcatcttctcctcgcactctcttattttattttattttattttttggttgatggagcctcactctgtcagccagactggagtgtggagtgcagtggcatgatctctgctcactgcaacctctgcctcctgggttcaagcgattcttctgcctcagcctccagagtagctgggactacaggtgcacgctgccacgcccagttaatttttttgtattttagtagcgatggggtttcactgtgttgcccaggctggttttgaactccagagctcaggcaatccacccacttcggcctcccaaagtgctaggattacaggcctgagccaccgcgcccggcccctactctattttattagtacaaatttaagtctaagcatgagggtaagtgacatttacagagtcacccagtgtagttgtagtggggttgaatcacggccccccagcattgtgcaaggtgtaattcctggaacttgtgactgtgaccttatgtagaaaaaagatctttgcagatgcagttgagttaaggatctcaagaggaggttatcctggatttagggtggatcctaaatccaatgatagctgcaaaagtgagagcaaagcagagggagatttgaaatgcgaggcatgaggagaagaccatgtgaaaacagaggcagagacgacctcagggagcaccagacaccaccacgggctgcaagaggcaaagaggaattatcccctagagacttcccccacggccctgccgacccaccttgatttcagacttctggcctccagaactgtgagagaatgaatctctgttatcctaaaccgccaagtttgtggtaatttgttccggcagccctagaaaagtcatacatccaattaggaaatggctggaaagggctccaagccagggtttctgtcttctggattggttatccctgctccatctcagtgcccttctcacccaaatgccagtgagtgaagagcagccatcctgatccgggagccacacctggcaggagtcacacctggcacctggagtcacacctggcgggacagggctgtgtgtcccttgcgtttgtttccggcagccctttctcctgtcctcagtctggctcactttccctgccaagcctcagagcaggtttggaggccttggagaggaaggagaattgggcagtgacgtgatgatggcaccaacatctcgtgcttgggcttttgattcaaccccctaactaatctccttgctgcagccacatcctctgtgacccaagtcacatattgcttgttgatgcacagctccctaagtgctctcctataccaaagggtcatgaagcccagaagccacgtttcccagattccttcacctgcagggtcccagtgagatcccactgatgagagatctgaaaggtcaaagaaccagagaacagtgagcctccctccggcagctgagagcccctgcaggggtgcgggcagtcagcagactttgaggtgtgcccatgtttgttgagcatctacccaacagtcacccaagtagccaaaactacagactcgacttttcctgtggtccttatacttagggatttcctgaggactaccttccccactgacattccccagcctcccagtagtggataaaggtctgagtctttgtatgaaaactatctacttgacgcatccagattagctcctgttttttagagggaaccttgacaaagacaactcatctcggtgaaatgaatattttattacgtcccatttcttctgataaacacccatgggctcctggtgcatggtcagctccttagcttgactatcaaggacttgctttggtcctcttcctgggcctccacatcccctctcaccagtcaggccaggacaccaaatgcctctgtgctgtcatagtcctggactttctcgtcctgttccctctgcctgaaatgatcgttccttctctacctggaatattcctgtgtgtttttaaagaaccaacgcaaatgtcccctcaaaaatgcccagacagagcaacttgcttccccagacccattgtcactgttggattctctgggattcagaatcagagatggagatgagtgtttattaggatgtttattggaaattgccccctggactagcagctatggaagggaaggaagggatgagcagcaggctgcgggaggaagtgagttgacgcagacctcaggacatcattagccaactccacggggagctaaaatggcccgtccgagtctgcaacgggcaggactggctgaggctttcaaccctagcctccatcagttgctggatgtgcagctctcagaaaggcagaccttgggagtacactctgcagctgacacagtccctggaggggctactgctaaagactgtgtgcctaagtgccctggcagctggggagacaagtttctttaaagagagacctgggcagggcatcaccagatgcaccatacccatttagagcaagatgtcttcaagaataaaatatttattctgtgtctctgcatgcttggtaccaagtacataaagcttgctcagtgaatgtttagcgggcacataattagtaaaagaatgaatgaatgagtgaacaaatgaatggatataagggagtggaagagattgaagcccgattaagcaggaatttcttcaaataatttctatacaagtagagaattttcgcccacacctgttgtctatgcttttggccctgggtcgtagtatatcaattttggtcaggacaagggaaaagtggggcatggcttaacccttggtgtaggtggtaaaaaaaataaccagaaaatcccaagaagtagataaagcattggatttatgtgtttgaaatgagacagtgccacagagagcacagggctcgggaactctttccaccatacacagagtccatggtggaaataaccttaagagactttgggaatcccaacctcttgcagtttcccttaaaaattcccatgagaacagcacaaaagcatcagatcatagcaacactggaaagtgagacaggtgaacttttgacagaatctgggagagttttccctcaactccaaggctaataggaatggtcggaaaaacagagctcagccacctatgccgtgccactaacaaaaggaagatgtgcatccatccttctctgtccctctagtagaagataaaggtctgtaccaatctaaatgggacagacatccctttacagcatgaagaggactttctgaagcacttaatgttctattgttttcctcccacctttcttttcacatcctgctcaaggctgaaactcacaaatacaacagggcaaaaattatcagagacattgtggcagcgcattgcatcttggaaggtgtcgttttcacaagtgcagtgctataggtgggctggaaggaatacttctgtggatggtggtttttcatgtacaccatctgttcatagtgtcagagaaccaggcagtgagtgacagagaggatccaacccctgtccttctgaatctcatcatagttaataataatggctaacattgattgagaatttagtatttgcctggtactaagtcagaggtcagcaaactacagcctatgcatggacccctcagctgcctgtttttgtaaagctttgttggaacacagcctcatccatccatccatttatccattgtctctgcagttgtcacaccccaacagtagaattgagtagttgttaacaaaaacttttcggcctgctaagcctaaaatattgactctctggccctttatggaaaaagtttgtcagcctttctactattacctgtattaattcagttaatcctcaagcttaactgaggatcctgtaaggtttgggttttttttttttttttttgagacagagtcttgctctgtcgccaggctggagtacagtggctcaatcttggctcactgcaacctccgcctcctgggttcaagtgattctcctgcctcagcctcccaggcagctgagattacaatcgtgcgccaccatgcacagctaatttttatatttttagtagagatggggtttcaccacgttggccaggatagtcttgatctcctgacctcatgatccacctgccttggactcccaaagtgctgggattacaggggtgagctaccgcacctggccaggtttgtctttttattatctccattttacagattgggaaacaaagacagagaaaaatctatgtaatttgcccagggatgcactttaggaaatgagagggctgggttttgactgcaggggtgtggctccagagcctgcatcttcattgctgtgctgtgctcctaagaacaaggctgtaagattaaaaaaaaaaaaaaaaatcttccctatattaggaattagggtgtgagatatacctatctacctgccttccaagtgtatattcaaaaagaggatttgacagatgagggacaaacatgctatccttgttcttttggcaaaagatgagaagcaccggtccacagtatttagaagggaataggtcgagactcaataaattgcatatgggcacgtgatctatactataaaagtgatgcagcatcagaaatgcacaggctcagaaaatacaccattcatagatccttcctggggaaataatcgttgcaaaggtacttcagagcctcgaaagatgagctaaaaatcaagaattttaaaaggggtaatcatggcatgaaaaactggcatgcattccctggggggcgtctacaggagccctattcaacttgtttcaaagctcttgaggagcattttcatctccgcaaactgtctctgatgaagtatcttcactgttttgttcacagctgtactcccggggcctacaacagtgcctggtgtggagcaggcactcaatatacatttgttgtgaaactaacctgcaacatcagtgaacaggcagccctgttgaaggggtgcttgctcctttcccattggaatttggatatagcttcaatgcagacaaggccactataaactgttatcccccattaagcctcttcttcaggaaaaatttactaaccacagtcacaaacccaagtaaatgccataactccttggaaagcactaacctatgccagcaaatgagactgtaaggaaatacctcaagacatgtgtggctgtctttccgtgaggacttgtcactcctcctttctacttttctgtttgtttccccatgtattgttttatagttaaaaagaatattttcccatgctccctctaaatatgatattccgtcatctctacagaaaccctcctaggactgccttagataactctttgggtgatgaacacagtagggctctagaaagcttattaggagttaaattctgttcccaccaaattcatatgttgatgtcttcactcccagtatctcaaaatgtgaccttatttggaagtagtcattctagatgtaattagctaagataaagccatattggagtagggtgtgctctgaattcgatgtgactggtgttttttccttaacaaatggagacagatgcacacagggataaaccatgtgaatctgaaggcagagataaggaggaggggtacatctacaacccaaggaatgccaaagatcgccagcaaaccaccagaagctaggggagggcatggaacagattctccctcactggcctcagaaagaaccaaccctgctgacaccttgatctcaggctttcagcctccaggactgtgagacgatcaacttctgttgtttcagccactcactttgtggtctttgttatggcggcttcagggaacccattcagctcattgcttccctggcagttgtcagcactagagctgcctctacttcctgattttgtcttgttctctttccatctgggtctaggttctactgcagggcttggtggaactgacagagacagtatctttggtggtctagagtgcagagaccacttgactggatgaggtggacagcagcaagaggaaggggaacccaagagatggttggggtctgcattgtggtcaagggggatagtccaaagtgcattttggtacaaaaagtgggacaggggaggagggctagggatggggaatgggagaaaggtaagactgaaataggaaactagctttgcagctgagaggatgggggcaggtggaggagtgagggatgaaaggggaagagtgggttcaggatgaaaaccgtagaaaatctaggggttcaggtgcttgatttcaagaggcctcagttgatggacatatcctagtggcttcaaggactcagagggtctgggagatgccttctgtgtcatttctgtgagtcgtcattatctcctggtgtccatttcctacctcctggcacaccagggcaactatggtgcctcagcaataaggaccgcactcccagctggccctcactggggtagggattggagtcctttccagaagtgcatgtgggaaggcagtttcaagagagacaatgtagggcagtggtcaagaacacaggctaggccaggcgcggtggttcacgcctgtaatcccagcactttgggaggctgaggcgggcagattgcctgaggtcaggagttctagaccaacctggccaacatggtgaaatgctgtctctactaaaaatacaaaaattagctgggtatgatggcacatgcctgtaattccagttacttgggaggcttaggcaggagaattgtttgaaccctggaggcgaaggttgcagtgagccgagatcatgccactgtactccatcctgggcaacagagcgagactccttctcaaaaaataaataaataataaataattaaaaaagcacaggctctggacccatgctacagtgctgtggaatctggtaacctgtcctgtcccttcttgggaaaagcagggaacatccagtggacaggaactggcatgatcgccaggttattgtggtctaccctgataggctgaggctcaggcaacctgtctggggaaaaaaagtggttctcaaacttgagtgggtgtcagcatcccctgggggacccagatgactgaccccactcagagtttctggtctagtcagtctagcttggggcccaaggatttactttttgaggggttccccatgacgttgatgtatctggctcagggccacacttggagaaccactggcaaagagagatgttccttgttgtcaacagcatggagatgttccatggcttcctggtgccttctaggcccgctgcctctgtggacagtgagactgggacctgccttaccctgctgaattccagggtcagttatctcactgttgtagtcgaagatctgcatgagggctcagaaatgccgcttctgccactgatgatcatggtagctaattctcaacatgtcaggtactattctaagcgtgtaacatacagacacatttaattcacgtaacaagcctaggaagcatgtacaacttttgccatcatcacctccatttttcagatggagaaactgaggcttatagatgttaagtatgttgcccaaggccacacagctgagagctgacagagctgggatttgatctggcagtttgagtcaacagtccatgcccttatctttcattgttccactgatcatgcaggagaagggaggcaagaaatgacccttgtaatgttggacaagttatctggcctctctttgccctcattcttacttcaaaaaaggaaatagcttttccaatcttagaagaaaaaaatacctttacgttaaaaaaataagctgtcaggattaattggataacagctgtcaaagtcttgtagctccttagaggatggtaaaataggaggaataattattgtgctattttctttgcagaccttagtacatttgggggagtcaataagtgtctaattatattcttggtaattagcagtgatggaaagaaaatggctcaggctgttggagttgggcagagggagagtcttcatgtttaatggccagtggccaagacctcctgcccctgagagaggtaggcagggcgtggcccagggtaggaggtagtttaacaagttagcacccctgtggtagcaccatttgttgattcgcccaaatttttgggcccctgccctatcagggctggggaattagagaccagctagtccagtggttatcaaagtgtggtccacagatcagtcccatcagcatcacttagaaacttgttagaagtgcagattcttggactccaccccaaatctactgggtatgggacccggcacagtttaacaagctttccaagtaattctgatgcacactgcgatttgggaaccgctgtttcagagggaaatgatactgatcttggagtcagatacacctcaatttgaatgctggctctatcaccctttggctgtgagactctgggcaaatcagggcacctctctgaatatcaagttccttatatataaactgaagggtgagaggttagagaggtggtctctaaggcacttgcattctgtctgcaatttcttttagcccccccacaaggcagaaactgtcttgttccttggctttgaaacaggctatttcatctgcatggaacattctttctgttcccttttcccctgtctgacacctacataacttagacctcagcctacagtttatttgctccagaaagttgtaggtgttttctttttatacttcttcccccaaatcaagtctgggttcttgccttgtcatagaactttccacattcctgtaatggctctttagaagtctgtaatctctaagaggataaaaactcttccatgctgactgctgttcccctagtgtcagacacatagtaggtgcacaaataatacttgtggttagaacaaattttattaacttgatgaaatgcttggctttggtggatttcataaggagactggtggaggggttagccttcatgaatggaaccaccttggggaaactgaggcatagaggtaccagtggagttagggatgcagtggcagagagaagccaggggagaaagccagctccagtagttgaggatttgaggggcgggtgctgtggaactgggggcgatctttagcagacctccatgggaccccttccacctggtatccgcgttagatggtgtgatacacgcaccttcagtgcttgcagcatgggctactagtgaagagcaaaataatgtgatggcatctgggcagcacacacggtaataagtcactcctagtatccccagggcaggcattttgcaaagctcagagtaactcttagcttctgtttattatttatttatatatttatcttggacagggttatggagctctttgagaaatagatggatgctctccccaggaagaaaaaaagagcacaaagacacaaacattccccactgtcgaccttgccactcactgggtatgtgaggaggttgctttcagacccagtcgtggtaagggagataaaagcctcaggtgaggggaagggtagacttaaatacttgatgtctctcccagccctggcattttaaagcttggcaataatagcgatgacccaatttagtaatgtgaaggcaagacggcaccattttaacaggattagtcatctcttctttttgctgtcttttctccccctttccatttgtgtcttttcccattgcaaatatacgaggtaataatccagtattttctatggagcatggcaaacatgctatatataagacacagttgaacattctgtgagtgtaattggagcataaatgtaactaatcaaaatattatcatgccaacggatgtgtgaagagtttggagatttaaaaatatatatattttagttccatgtcatttccatttagagctgcagaagcaagggactcagcccaatgaatgtcaagaacaatttggggtctgacaatgttcccagcagccctgttgttctctttactcttaatatggcagcagcttgacaactgacttaatttttgttcgttctttccattctttacccctcttcctgcatgaaccagctccccagcgcaaggccagctaactccagggagttgatgatcactccttgccatcaaacacaacgtgcccacatgtggtgtgcagcctagcagctaaatgagaattataacttcctaggtttgaatcctggctctgctaccagctgtgtggccttgaaaaagtcacttaagctctctgtttctcagttttcccaactgtaaaagaagaatgatagtagtcactacctcatagggttgatataagaattaaacaaatgaatcttaagtaaaacatgatggtatgtgttggctgttgttattgttaagaagaggagtgactgagaagataaataaattctcatgagaacacaaaaagtactgcatttctttgggaacaagacccaaggagaaagatctttccttcccaccccttcttcagagagagtctaggtagaaaatccaagccagcctgggctcctgacttaccactaactagtcaggtaaagtcgctgtaaagtcttggaaacagacttctgtagctggaaggaactttaaaacctctacctgtatatatacctgttttgcacgtgaagaaacagacagaattcttgcttacggggcagtgtgtggttaaaatgggtgcataggaagaggtgaagagtctgaagggagagtagcattatctgaccttcagtttcatctggactttgccaaatgaattgtctatttccaacatcaaagagcaaatcggtcaagaccttatgttttacagtttatgttgctgagttgtcattctgttgtgttttgggttccattgtttttcctacaataacatttagttttgctcctgggagattgaattgaattgttggggaaggcaagttatgaagtaataaagggagacgcaggtcccagtatgccctgcaacattgtcccggggtctgttttcatcacatcatcattggaaggaccagaagaagtatgctgggtaaaaagtctttattttcacttttgcttttgtttgggaggtcaggagggatgcaagcttgtgtaggggttgcatgtagtttacatgttagtctgctttgtctccataatcttttgcctcttctctccccctgctcagtaccccttccctcgcctgcagttcatgtctcctgcttctccttctgcctctttcccttgttccccttcctcccttcttcccttccatccatcctcttccccttttccctcctttcttcatcttagttttcattactcttttgttttctccttcttttctttcttcttccccttctccattccttctttgtcttgtgtctctccctcttcctctctgccttcctttttttctcagaaagtgtaaaagaatgcaggcggctagggatttggtctttgaggaaaagacccacgtgcacacaaactccctgcctgactctgcttgcattagggtatccagcaccggttagcagagcctctccaccagtgcgccttcaaatccaatcactgggggttaataccatatttaaacgacattatccacagctacatggattattagatagttgtttcttcaaaaattgccttaacaaatttgcatatgaaatgctgaaaccccaacttaccggtctgaatgaatggttacagaaatgcttattacttgttcacgcaaagtgacaaaatgttcacaatattcaattcctttgaagtttcaggatgtatcttttttttgttttaaataggtattatatatccattaagttccaattaacaccacctccccattttctggtatattagaaaagcagcagatttcttttttttgacacttgataattagattgctttcatagataataagaataatgttgaatgatatgtttattggtatggctattggtctattgttatgtttgcaattggcttgatgattactagttttcatggtaatactggtagcactatctgcttctcttgcacctacattttcttacttgaaagtgcattgtgccttttgatgtctttgtgccactttcacttttattatgactagatagctaaatttcatcattatggacttttaaattagatcctgtttaaaatacctataatggaagtatgcactctgaagtataggaacaacaattcagaagtgcctgtttcctggacattagtgaaagccatgcagggaaagtgatatttaagtagtttaatgaaggaccatggctgagctgggtggcgtggatttcaggaagggtatcacctgggcaaaagcctagcagcagggacatgcgtaggatgtttgaagtgtgtattagtttcctattgctgctgtaacaaattaccacaaatttagtggccgaaaccccacacattttaatctggacatcagaagtcctaagtgggtcacactggggtacattcaaggtatcagggctgcattcttttctggaggctctagggtagagtttgttttctcaccttttctagtttttttctggccacctgcagtttttggttcatggctccttctttcatctcaaagtaagcagcatagcctcctcagatagctcctcaactgtgattctgactctcctggcccccttgtctacctaaaggacccttgtgattacattgtgctcagctggaaaatccagaataatctccccatctcaagcttatctggttaataaccttaattccatctgaaccttaattctcttgccatgaaaggtaacatattacaggtttcaaatattaggatatggacatctttgggaggcccttattctgtctaccacaaagtggccgaggactgtgtttgcgggggagggtgggagagatagtcttcatataagaggcaggaggggtgggggtcaggatgtgtaaggctccacatattctcatgaaagaccttgggctttataggaagtggggaatttcctataaaggaagacctcaatggaagtcgagaacatgtcacggttggctttgtatctcagaaagatggtgctgagtactgttttattggatggtgagagaatcaaggactagactgcttaggaagtcgttgcaaaataaacagtttctgacacaaatgccatggacctgaattaggccagtgccaagggagtggaaaggaagaagatggtcagagaaacaaaaggaggaggcatccctggaccttgatgccttatcaattgtgggaggtggagacggggcagcagattttactctgcctctcagtggatttcttactattttcttcttcagtctattaaggtctccctgctacactgaaacaaaactttaggggtatgggaaagatagaaaagaagctgtttttgaggacctacatgcagcgatacttatctacgcactttataaatagtagttgtattaatcctcatggattacatgaggccacaatatgagatgtgttttatagccattttatagaagatggtacttgagagtcaaagagttaagtgacttgtttaagatcatcagagagaagagatgtatcttgggttccagtttatcccagggaccccttgttagaagcatcctacattgtccttgctcaccagggcttgggcctcaacaaacagttgttgaactgcctgtcaaagctgaggctgggaatgcccaacgtgtgtgcacatacttctcctaagtcatgtgacatgtagaatgcctaggacttctatgcttctgcttcctgaaggcaacatatgctcttttccctcttaaatagctatctgggaaaccacttctgtggctgtacagctcgggcaaggaacggcagagttgtctgcggtagaaactgaaatcggagtcggaaaatctgagtctaaatcttcattgtgttggttgaccttggccaagttacttgttccctactggagtttataaaatgagtaggttgggttagttaagttcctgtgactcacttggatgtaatttgttatgctttggtaagtaatccacaacttcaagaccagtgctatccaacagaaatttctgtgacaatggatgtattctacaccagcactgttcaatatggtatccaccagtcatgtatgtctactgggcacttgaaatgtggctagtatctctaagtaaatgatttttttctacttaattttaattattttaaataggcatatggcgttattagctactggttaggaaagtgcattcctagaccctgtagtctctgctttctaagaaggaataattggtttgagtatttatcactttctggctatgtggctttaagaaaatgactttacctctctgttccttcgtattccttgctttaaaacagagattgcatggcaccacctcattagggtgctaaacaatgcttagatcaatgcctggcacataataagttctcaataaacataaggttttataaacggcattgggctcactgttacctgctgttggctatctgttataaaattagcgtttattaagtaccgtttttacttaatattcactgaaaacaaacaactttgatctgtaggtttcattatcccattttatagatgagggcattgaggcccagggaattttactgacttgctcaaagtcacacaactaagaaatgccagaagctggagtgaaacccagtttacttaattgaagatccagaacttgtttcatgtcaccacagctgcttggcttttggcagcatttgaggccccaccagcatccattcccttcaagtaggtgctggcactgggagctggcggggccacctgtctgcagggaccatgctgagctcttggtgcccaaggccctcagctgccagtcgcccgagcacactcatgtaatcttaatgaacaatgtgcaaagccattaaaaactcaattaggactttctttttactgccgacgtgaggaaatgcaatcctgaggtgctcatgtgtaaacacaatagccaccatctgctatggagaagcattttgcctccaaaaaggagatctgtgttgcagacacatcaataacgaggcgcttatcaaggcattattatgcacgaaggggaaaaatgcaaaatttatggccagccagagagtacttcctggtttaattccacaattttcagtgctatgtataataactatgaggaaactaatgctgttttatgttccttatcacgttagtagattttttttttttaagggagaagggaaaagaatgtatttacagtctttctctttcttgtttctgactgatcttggcgtaatgaccggctcatttttgatctccaggaaactgacagccctgggatgatattaattatgccaacctgttgatcaaagcgggccccacagagctgatgatatacaagggttttcactcctgagcaatctctagtggcgcgcttgagctcaactcgcagataggctcccttcctttctggagggtgtggtcagacctatataaggtgggctacatgtggaaggggctagagatggccgctggatcccaccccccacccccaagaccttacactagcattgctggatgcttctgtgcctttgcctgggctattctatttcaaatgcctcccaagttaccaccaaggcttgctgctcttaatgatatccttaggtagcctgtcttgcaactttgcttagtagctactgtttcacatcttattgccttaaataaagggacttgtagctgaataatagtttattccctttttacttaaaatccaagatgagtgctcctaataggtgagtagccttctgtgtggttgtgctcattcagggaacctggcttcttttatggtgcactgccctctcctaggctcttgagctctgggacattcagctggtagatgggaaaatagaatgggccaatgattctcactgctttatgtacatgccgatcacctggggatcctgataaactgcagatccaaactcaataggcctgggggtggatgtgagattcttgtttctcacaagctcccaggtgatgctggggtggctggtccaaggaccagtctttgagaggcaagatcatttagtatggaggtgtgggggtgagagggaggcagcttttaccaaccaggcctggaaagtggcacacatcatactcatgccccattatctagaactcagttgcatgtccctaccaaatgctaaagggaggctggaagacatagtctagctgtgtgcccagaacaatgttacagggttgtgcatgaagctacatggaacagggcaatctctacctcctcagcgagcctgccctgctaccgaagctaggatggaaagaagtgggatcatgaactggtggaaggaaaaccttcccaactctctctacagtggattgtaaggagccaagggtacatgagcccgtggcgtgaattggcaggaggacaggagctgaaatgtgcatgcgggtatcatgggattcagagaggagagagacactttgcttctcaggctgctgcctctgctgggagatgtgctactcctcagtggcagaggcagtcacaaaccctttgtggggcttgtgagttgctacttacctgtccaaggaaaccttttggaaccctgtggcatgtaggccagtggacagatatgggcatggatgcaggctcggtctcatctctaagcctcaatttctgcccctataattgctcctttttagctgcccccttgcgagtttatgataattcaataacttctctgacatagagacattgctccacttaccttgtgttactgcacggccataaaactgggacgccttactcagaaacaccaggcaaagacacccgcacctttgttccacttccagtggctccttccccaggaggtgctacattttccgaaatcatgacttttgcggcaatatggatggaactagagacaataatcttaagtgaagtaactccaaaacagaaaatcaatacggcatgttctcacttataagtggtagctaaataatgcgtacacatggacgcagagtgtgaaatgatattcactggaggcttggaagagttggagggtgggatgggggtgagagatgagaaattacttaatggatacaatatacatcatttggttgctagtcaaactaaaagcccggactctgccactatgcaacatatccatgaaacacagctgcacttgtatcccttatatttacacacaagtttttctcattggtaggatggcgaaaacctgatagccactggttcaggtttctctgtgcttttcacctggctaccttttggtacaaacccacccaactatcctaagtggtcatcccagtaagacaactgtggccctagggatctgggcacagttggagggtgggtccatggccatccgcctgctctgcatggtggttcaggggaaacatgcagaaagtctaatttggccgtaagtccaagttactttgtgaataataacgtggaggttttgaactcctctctctctgtctctccctttctatctctctcatgtctgtttttaaattcactcagaacctgaaggagacagggtttgattggtaccttctagaatcccaagaagttatgggtttcccagcacttattaactgggagctgttagtctttttggtattagggtgaaagaatgaggtgacttttagctattgaagtagctcaacttggctgaggataagtggtcttaaggtttatttttgaattgaagattttagtggttttctaggtggaaactgtccttctagaatcaactgagtttatctgcagtgttccatgatgcagtttatttcatagaatcataagactctaagttcagccctcccagttgcttgtgaaatttccttaatcatctctttaatttgtctaggctctgttttgccacctgctttggtggggactcactttgtctctggccagtccattctattttgcaccaactttacttgttagaaagttatttgtacactgaactgaaatgtaccccctcatggtttctttcatgagtctgccctcccaggcagctttatcaataagctattgtcacaataaagctgcatgacacactgaaaagaaactcactggcaaacaacaataagcgtttattctagctctcatggaactgtgcattgattgtagattggctgatctaggttgggcttttgggccatgtggctgtgattccagctgcaggggtggcatggcttggttctttaagatcagttcaagtcaggtgtcctccatgtgtgtattcttgatcccaagctgaaaggggcagcagctactgggggcacatccttttcatgaaaggtagcagtagtgcaagacggcaagcccagcaaggcaagcacattttaacctttgcttgaatcattctgttagcatcctattgaccaaaacaagtcatatggtggagcccaaagtcaagggatggggacataccctctgtttctgctggaaggaactgcaaagccagtggcaagggacatggatccagggagggataaagaattggaaacaaccatttaatttgtcaaagcaactcaaaagaggctcacttcgtcctacaaggaaactttttgaatgcttggagatgttttctgcaaacagtaatagtagctatgttttctgcaaatagcaatagtagcacgttgtagaaatacttcatacatgttaccatctcttaattcttaaaaccaccttattgaatagattttttatacccaattacagaagaggatactcaggctcagagagatgtggcttttgcagggtcacccagacccttctagagtgacttgatctctggccactcctctggccaccatgtttatgggtgtgactgattttcagaaggattttcttactttctctttgtctctacttcccacctgctttgtgggtctccaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtatggcattttaccatggttttatttttgaaaatttgtaataaatctatacacctttgctctccctacaggtgctaggtctagaaaggacttcatttattcactcgtgtttactgcgcttctcctcctagccaagctctgcagaggtgacctaacacagccgctgtcccacttgaattcatcatttgtaggaaaagactgatatgtagataaaataacaatgtaccaggatgcatgtggctcctgaagatgctagaggaacataggcattgattcctttttataaagtcagtgcttatgacatgatgagggaggtactagtactagcctattttatggatgaaaagattgaggttcggagagatgaaataactcgtaaaagatcaccctctggggaatggggtgtttgctggggaaggcaattaggatggtttgtaagaggagatgacatctaagatgaatcttgaagaatgaatacaaatttattttaaaagggagggagggaaaggcatttgagttgtcacagacagtgtgtacagtgagctgcaggggtggatgatagactatggcagagtttggaaagtctaagttgtttaaggtacattgcaaagaggacagacagggagatcagcctgcagggacaagcagatcatggggggctttgaatgtcaggctaatggatggaacttagtttaaagcagtgctgctcatactgtccatggtgaagggacacttcctctcaactcattgtggagcaatactcttataaaccatggtaaaaaaaaaaaatcatggcaatgacagattgttgcaacagttcctaaacctctctctctttccttccttatctccttgcgaaccgatgcacacagtgcacagattggcaccaatccataaagcatgcttagaggaacatttctccacattgtcttggcctggggccattgaaagttttgtttttttttttttaacaatgttattaaggtaaaatgtacatatcacagaatccacctattttaagtgtgcaatcccatgactttagaaaacctattgaattgtgcaaccatcattataaagcagtccagaacatgttcatcatcctagtaagatacactgtgctcatttgcagttaatctccacttgcactgttgaaaggttttaggttagagggtgaggcagtcagatctgcattttggagaaatttctctagcatctgaagcagaagatgaaccggtggctgggggcttcttagacattctccaagttaatatccatggtacagttcttccagattttagtgttaggaatacatgtatctattgagattgcttgttgggtttaccttaatgaggcaattcaagctttatttcccttttgccttggtaacgagaaatcagaatttaatactcaattaccctcaatatttagactggatttttgccatacatatttcaattttatcctcaatggcttgtgatttccttttagaataatgttatttttcttcatgatgcatttcctgaaactcctttcagaaataggggagaggtagtgatgatgatggtaatggtggtgatggtgatacctaccgttcattgggtgtttatcatgttccaggcacagtacaaaatgtttcacatacattaccttgtttaatcttcacaacaatcctttgaggcaggtactacgtacccattttataggtgatgaaacgaaggctcagaaatggtaagtgataacccaagcttgaacggaggtagtgccttgttttttacccgttttgtttgatttcactgtctaagctagtataatccagtataaatataatgggaaccacacatgtcatttataaacgtttagtagccacattaaaaagtaaaaggaaatcagtgaaattaattttagtaatacattttacttaaaccaacgtatccaaaatactatcacttggacatgtaatcaatctaaacaattattagtgagatgttttctgttctctccctgtcaatctttataattcagtctatattttacacttacagtaagtctcaatttaaatgttttattttcattagtaataatgatctgtatttggactcataaaatgtatagctgaagaagtggatacatatacacaagttgttccaaacattcttaagtgaattgggtatcagtttttaaattaaaatgtaaggtaactgaagttaagtaaaatgagaagttcagtttcctagtctcattagccacgcttcagtagctcgtggttgtcaaattagtacagatcataattcttaaccacttggctccacaatttcccctagtagagttcttgaaaggcttagccacgcctggaacttgtggatggggagatgaagcggggtaactccaaggctgggctctcagaagggacctggcctttatgaggtgctggttctgctcattctcatcctccattgctggagaatcccgcagctatctcttgtaatgccttggtctgtgttgagggttttcttaaggtttttattttggggttctttgtcaggagacttaaaggagtaaataatgagatataatggcaatgactgtcgaacagcacaggtgactcccgcaatcctggagatctgcaagcagcctgggagatggacctaagtagccttgtttgggaccacgtttcctttgcttttcccccagcctcatctccttggcctgcccatgggtgaccaagagccagaggcaggaagtaaggaaagttaggaagagagcagaaataaaagaggaagtgagaaagagaagaaaagagaaaaagagagagtaaattcttggaagaactcatcacaccatcattcagccactcgctccctattctcatctgcttgtcagtcattttgcatcctgcgtgagccaggccagttcaggcattggtaacgcagaggtgagtgggacagagctggccttggggtggtcagggtggactgttgtcatttggtgtgaggttaagcccctgttcccttctttacaacagcaggaacctatgaatgaaagtggctaaaagcagagtcctttgtttttaacacgtgtcactaacaacgtgacgtgttgtatcctagatgttttgagacaaattatatatctttggcctctttacttcggtgtcttttccttttgtgtaatatgttttagtacaaacctttatctgaaactgatggtgtcagatatgtgtcagaattcacaatgtttggaatttagtaatatattagtaatatattggcatatcttctgtattttataacaaccctggtaggctctgaggcagtaccctgtaatcaaatgtaatatttctacagcaaaacttacacacactcacaagaaatgggataaataaagactgtaagtagtatcaggccattcggctgtgttcaggttttaccaccaaattactttttataatactaaggtgaagaacgttgttttcagagcttttggggtttcagaattgcattaagcatatagccttatattctctacctgcacagttgcgtgaacaaggggatcagatcttgcttgtacattctgggaagaatacccagtgtatgatttgtagagtgtgctctgtggaacatgtgttccccgagattctctgtagtgaaggctgatgtggtggaggtcacagcattttgaaaaagctgtgtgatgtattcggttctaggagactcacagttacccacgtgggagttctgaggagtcagaaagaaatccatttattggtgtttaacctcctgtcttgcctctaagtttgatcttggccctctttttgttggatgaccacctgactatagagatagtattctgcagacaggtggccctacatctcagtttgctgggacaaccctggtttactcccattatcctggtgaaattaagagcatccatttcatagtgtgccccagtttcagtgataaattatatagtcttcctatccatagacatttacagaatgcatactggcacatgtggcttaggtttatcctcattttgtagataaggcaaacattttctgttaagggcagaaagaaaacatttttgtctttacaagccatacaatttctattgcaattactcaattctgccattgtaccatgaaagcagtcatagataatatgtaaatgaatggacccagctgtgttccaacaaaactttatgtgcaaaaacaggtggtgggctggatttggcttccaggccatagctgaaccctgatgtacatgataaagctgatgatgtccagagttgcatagtgaagtccaagaacacgtaacaaattattggcaaagctgagagcagatcccagataccctactccctagactgtcaccactgtatcattgactgtagacataaagtatctctaaaagctcatgggcacggtcagtgagcctttaaggtttcaattagaaaccccatatataggaccagacacaaatgggtacaggatggggccacaggttgaagtacaatgaacaagaaaattgactgagtacagggacagtcataccatttgccatgcttttggatgaggcatggggggaaaggacatttctggagtaccccctatgttcacaccctatgagaggcatgagatctgtgcagtagctccctctattaggtggcaacatgtcctatcttccagcgtaggaagcactactggtaaattcaagtccccatgatccatcccaggtcctctggctctaagctctgctttgcctttagggaaaatagcttgcactttctgagaatcttcttcctagttgtgtaatgttagctgtatcctgtcatcattcagaatcacagttccctcatctgtagaatggagaggatattaggtatgataggaccttctgcagatgaaattagagaacatatatgtatcatcatgtcaggtatattagtctgttctcatactgctataaagaacttcccaagactgggtaatttataaagaaaagaggtttaattgactcacacttccacatggctggggaggcctcaggaaacttacaatcatggcagaaagggaagcaggcacatcttacatggtggaaggcaagagagagcctgtgaaggaggaactgtcaaacacttataaaaccatcagatcttgtgataactcattcagtatcacaagaacagtatggggaaaaccacccccatgatccaatcacctcccaccacgttcgtctctcaacatgtagggattatggggattacaattcaagatgtgatttgggtggggacacagagccaaaccatgccatcaggcttgcagtgggcctcagtggaaggaagggaggaagggagggagggaaaaaggaaaagagggaaaaagagacaaaggggaaggaggaaggaagcctttttaaaagaaatagccagtgttgttaagcctgtactcagtaacctccatgccctcccttggataagtagcctcatctgggagaattttctgatttgcaccttattggctactacagcctcattgcatttccttggctgagagcagcagtttggagagagatgttatacacacaccgtcactaatggttactcacttggccacaaacactgcagagtgcccacatagggacaagcacccacaagactctcagattcaaaacatacttgcacatatacacataagtacagtggcaagaaaaggaggcctatcagaaaatccaatgacactagcaaaatgggttttaaaattcaccagacctggagctctggtcctgtacatatgattctatgggctaaatacaaattactgggcttcggagctgatggtttatgtattaatttattaaagtcgtattttatagttctaaaattgacttttagctctgtaataaacactgaaatttcctctttctcattagtgagctttctggcaccagacttttggcaaggccgggggtgagaacctgcctctgccagccatctcccgacatgtgccttttcttgggaaagcaggggcttgtttgtttatttacttttaattgacaaatattaattgtgtgtatttagagggtgtagtgtgatattttgatctatgcatgtgttatagaaagacttagtcaaactaatgaacatatccatcacctcaccaacttaactttttttgtatagtgagaacattaaaaaaatctattctttcagcaattttgaaatgcacaatatattattattaaatgtggtcaccactcagtgctgaatgactgttaagtcacgtgtacttcagatcacagctcctttctaggtgatgttaatttgatttcatattttctaatgattctgaattttctgtttcaagatttaaaaaaataaaagaacttctgttaattttgcagccatctgcttgccctagtctccatcacctgcctaggaaaaattacctttatttggtagttattatcgctatataggcccctgaaattaaggactcacccagctttggttcaactggactttaaactcagtccctttccctggaaaaccgtgctatgtggcactctgtagatttagtaaattcactcacaatgaagtggagtttatcacaatgaggggcccactctaccactcttggaattctattccatctgcttccttacccatcccacttctctccactaagcatcaaatcctcctccttgtcttatacaggtctccttgggctgatagggtaaaaaaagtctctcttaattttaccctaaacaatctctccccatgaaaacatgtatatttatgttctaagaggagttctgatgtgccaacatttttctcttctcctgaaaatgtttgcagccccttgaaatttttgccatgcagattttctgctcaagaactataaaagattaggttaaaacaccaggtctgttaaaccatggcctgacatatccacaccctcctccaagtatgaacaaaaaccattttttggaaggatgagcaagactcatctcagagcctcttgtggggaattgcttcctggctttgcacaagtagtcatgcacagggagaggttttcacctttccatgcaagcctcatctcttcaacacccgcaccaggaggtctctaatgaagcctatgggctggagcatgtgcaatagatggtaggtccacatggcagccttggagctgaagagcatctacagagacgttggaattctcagcctgggccctctgctccactccctgtactcagggtctcggcctccatttactgacttggagtgccactgggtatgcatggcctgcctcctgaagacatcccatccctactcccctgcctcctgaagacaggaggaaaacactgcaccagagtcacctctagacttctctactcactcccctggctctcccatttcctgactttgattcctcaagggccgtggttgaattttcttgagagtgtgcttgggtcagagataaccattctccctctcctcagaacaccttggcaggtctttccatctctgagggtccaggcatcaccttgtccccttgtggtgtctgtccctaaaaactggagctggctatctattgggtggggcttcctatggctaggagtctcacgtcagaagcatattgatggagtgatcatctccctccaaggttgtaggtgtcttctggggcaccttttgatcatactcagtgtcattttacacaattacattcatagattattaccatttttacttcctctttttgtgaattacctgttgaagtcatttgccactttttaatttgaatgatttgggtttttttttttgttgattctcaagagtcctttacacataaaaaaggatattttcatattagctgacataggtattacaaatattattctcaacctgtcatttgacttttaattttgttttagatttttgctaacatacaaagcacacttgacaccatagttattaagaaagcattgtgtaactttaaataaattggtttttaagacattgtcactaatttctagttgtagtgaatttggttagaaaatgtataggcccaaagctaaacaatttcttcttcgagggatttattgaagttatattgtagcctagtatatgatttttttgcaactgagccataagcctttgaatggaagtttcattctgtctttacatttattaacatgtatctaggaaatacattattatttacattatatatacttgctttttcctatacgattagtagtcaaagtctaagacatagattaaagtcttcaacccatgtctttttcatcattttcttcacttaagtcccttgactcatgtgttttttctaaatgaccattttagtccacctaattttttcattgttcttttcagttaaaattctacttcaaggttttcacactatttttgcaacaactgctttctgtttatttgcatttctttattatgtctttcttcaacttgttctttttaatgttgtgcagtcattctgttttaggtgtttatcttatagcatacaattcagagatgtatgacatgggaagatttgagaaatgctaataaggtagaataaaaaggaaaatgaagatgagggctgaggcagaagttgaggcccaatagacaccctggtctccagcttgggtgactgaatgggtcatagtgccacttaaccatattccgtatttcagaaagaatagactattggtcaatgagggaaaaggtttgaggaggaatctgtgcagatctgttggattcacgtcattgatgtggtacctaggtagaaatacagatctgtgacctggacacctaagacggatgtgtgggtgaaaggtctagggtgcagagctgggctttggagttatcagtgcattggcagctgttgaagggagagtgtatgcagtgaaaagatgactaacaggggcccacgttagaagggaagatggagaaggaggaatgcctacagacctcccaggcattgaacagtgccagatttatgagaaaaataacaagaataaagtgttatctgagcctaaatagaaaaaagacccagaaatggagagtctatgaacactgacagttgtagaagaatggtcaagttgtgataataattctagtaaatatttcttgagaatgtaccatgtgccatacattgttctaagtggggtcttaactcccttaatctaaaaaatcactcaatgaggtagacactataattaaagatgcagaaaatgaggcacagagcagtaacataacttttccaggactactaactagcaagtggcacagccagggcttgaacctaggcacttggaacaagagtttaagcactgtactatcttccttcttaaagtaagataaagattgaaaatatctacttgattaagcaattagaagattattagtatcttccgtgtaagcagttttaggggaagttccagatcatattaggttaaagttttgcagtggaaagtcaggaagtgttgggagtcaatgaagataaaactgctgagaattttaagtgttactgaaacacaactggatggtattagagaaaacctgctgctgaagggtagtttttaaagaataggagaagctgttgacatgtcaaaattagggataaaagggagggtttggagatatagggtagacagagaaaaccaaaaagaatccaaaagatggaaaatatagcaagagtccgggtcaagagcgctgatgttccttgcaaagaagaggcaggggatggtgtggatggatatcaagtcagtgggtaaaaagttagaagtcagcccctctttccctcttgcctcttgaagatgtgggtgtctgctgggattacatgggtgcatgttgaaagggcggcagttgtgtaaggtacaggattggagaaggcaaatgtgttataggctgggcaaagttgcaataaaggtgcaaaggaatgggggctttaggagagactcgtatggagtctgaggagctcacatggtagcctggaccttctgcattaataatccaaggattagataagaaaagcagaggtccaggctaccacgtgagcctgaggagcaggtcaagaggagtcaactgggatgagactgtcggtagagactgtgccggagtatgggaaaatggaatttccaatttccagaaggtgaaaaatgaggtgaaagtggggctaaagtggattgaagaaggccattggaaccagagagttcaaggatgttggccatgctatccacacagacattcatatctccttggtgaagatagaggttgagtgatgagggaagctaaatgcattacaaaatttttatggaaatagcagtttaggtggaagtcagttgccttctactcctggataccaacaggtagattgccacttatttttaagagtgttattatagattcaaatgtaatatgttccttggcaatgtagaatcaactcatggtaaaccctccttggcttatggtagcttccaaggtaggcatctatcttatccttcataagaaagttggaatattagaaagtagttctctgtagaagaatggtcaagttgtggcttgacccttgaagctgcaatgagaaagatgcagactggggtttccgagacctcggtgtttgggttgtttttcctgcatctaagtgttatttctgaaatttgttaaaaatattcttcttttgctagccaccaaagtgtggcctttttaccttgtgttgaaaatcccagtcaattgccagggtagcgtgctgtcttaacagaaggtttcttgggttgcttctgatgggaagttgaaacataaagggctgggggccgggcagcttcttgtgatgaatgcctgcaactgtttctgtgaaattgactcccgccctgtgtgttgcaggtgatatttgaatccgtctcattgaagggtcatcctggctacatcgccgtggacgaggtccgggtccttgctcatccatgcagtaagtctttcccttcctcccaacacagccttgatccatgccagactgggtagcatagagcctgcaatcccttccattcattcagcttacaaacatctctcactctctctttctctttgaatccttcagaaatgcttacatactcaatgcaatcagtcctgaataaatccataattttgccggcctgttcaacaggcagcacctccaggaatttgcagagagtggcaaaacatctttgtttgaatctctctccattattaagggagtctaaagtcctgattgtttattagtgggattcagaccactgaagtggtagaattagagggctttggatagaatcttgtgcaattgtcttaaaaaaaaaaaaacacaccaccaccaaaacactgagcaaattagcacactgttccctcacagggaaaagtaccctgaagttattaattcttttaaaataattttaaatatactcatcagctccatgtaggcatagagatttctcatagtggttagtacttatggtacagcgtcaagagtcctcaaaggcgtggcactcctccatacccatctacttctttgccatatttagtctcagatattggaatgtgtttcagcagggagatgtggtttctggatttactaaatctcagaggccataagtcctgggtacaggtagttgagatgacatcatacccagtgacatttggttggggggactgaaatcaaactgatttgcatggagattatggcagaccctgggagggatacctggaatgccagccccatgagtttgttagtgttctgcagattggagattcccagtagtttcttggcagccatccagttctaggtaaccccctgtgggctctctccactcctcccatatgggcatgagtcatgctttgggctatggtgcagtttgctgctgcctcaagagacatcatgggtcctcctctccttatgtgcttctcaatcctcgcatttagggactattctcatttcagcctcatccatgttgctttaattgaaataactctttccacttctgctgcaatgaatttgtcagaccctcaaatgtaacttccctccctctgcctggcactagaatgccgttgtctgactcattgtcttagagccccttctctggaggaatttggaacacattacaagttccgaacattattttgagaaattgtgtttggatcctgtgcaggagagaccctctttcccaagaagcaactggtatcttgggaatgctgagatgctactgggctcttctttgcactggctgaaagtccctaccctctgggttacttcctgaggcttttagaatttctcagatgggtctgtcattcagtcatgcctggggaaatgtttctattgacccagacttcatgtgaagaggatcccagaaatccccccagctatgcagggtttatgtagtagatatgcatatgaatctccttcactagggtgaaatattccccaccctggactcgtgggagtcaccatcagctgctcatttgagaatgagcctaagactgggcaactgtgttgggagatgtctgtgctacctgtggtccatttaattgcatgcgctcaatcttgcactacctccagtttcgaggtagtctctctgaaacatgccttctgtcttcctcattccctgcctacatcccatccactcagagcgtgcttgcctctgccacatctacctgtgttcctgcttcttactttgtgctggatgcttggactttagctttctagtaggtgacagctggcttttcccaagggaaaatagcatgagtctctctacctggatcccagaactttgtgctctaatgggaattttcatctccgtcctgatgcccaaccttgacacctgtctcttaccctagccgtaactaccttcaaggccagagtggtaaaagctctgccttacctccaagcactgaccatggtttgctgtcacaagcaaatgcatcctttttctttgataaatctccatgggagagggctctttggagggcactggaatgactttccaccccccaaagtctcatgaatccttttgaaattctcgtttcactggggttgctcctgaagtcaggattctcctgacaacctcatcctcctcctgcagaggggtgtgggtggcatggtcatgaaattgctgaaagccagttacccagcaaatggaccatgggatataactcaggaaggcgtgatcctggctttatgtctgcataatgtgctcctgttgggttcaacctcagtgttgaggcagcttaagcataaacttcccagaaagcatgatgtgaagaccccataggagtggctggaattggaaaaaatttcacttaactatatggacaaatactggcaatgtatataatgcctgaggtatatccacagctcacgaatcatgtggagttgagtagggcctagcaaagtccctttcctaaggaccagtgctcagtccatacctagcccaggtttttattctttctttcagcaagtaaattattgtacatcagctatgtgttaagaactttcctaggcacagtgatacttaagtgactaagaaaggttcggtccttgtactcatggtgtttgattagcagaagagccagtggaaagaaaggcactaaatcagtaactaatattaagtaaccagaaatttcagatagtgaaaataatagtggatatagtaagtgtcggtgtctgggatacgggagggctgcttggatatagtggtcagaggagatatctttgaaaatgtgacctgggctgggactcaaatcacaggagggagttcacagtctagtgatttggtggaggggtgcttcagacagaggagatagtggttgcagaggccctgcacacggagttggcttgatgctgccagcatgtcctgagcatacagggcacaggagaaggtggtcagggcaaatgttgggcaggaaagcctggactttgggcagcatcgtgagtagtttaaatgtttgtctaagggcagggaggctctgctgcagggagtgctgctggagaagggtcacttgggctgctctgtgttggaggaccatagagaagatgtcgggagacctaggaggaagaaagttctggagccatgcaagaggtggtggtggcccgcaccagggtgactgagagacatccattcatcatccaacaagtatttactgagcgtgagctccatgtcaggcaccattctgggtttgtgggagtgagaaagacagattgactgtctgtcttcatggacttctattgaagtgaaggaggctgaagcaaaacaaataaagtaattatatgattatattattataatctatatattatataattgtacaagcattatatagaagtatatattatataaatgtgagttatagtatataaataattatataatcatataatttacatttatatatcatatatacatttataattatataagcatatcatatataattatatgatatgcttatataattatatgatatgattatataattatatgcacagacagtgcgttagtttgctaaagctgctataacaaaacccctcagactggatggcttaagcaacttaaatgtattttattttctcacagttctggaggctggcagttcaaggtcaaggtgttggccaccgtagtttctcctgaggctctttctttgcttgcaggtggctgccttcttgctgaggcttcacatggtcattcctctgtacttacaatcctttggtgtctcccggtgcattcaaatgtcctcctctgttgagaatactggtcagattggattggattagggctttccctaaaggcctcattttaatttaatcatgtctttaaaggccctgctgctaaaaataggaacatttgagatactgggggttggggtcatatatcaaaagataaatctgggggagacacagttcagaccatgacaaattatgagcaggacaatgaagaaacttagagcatagaggtggatagaggtgcagagattagcgatccatttaggaggcagagccaactggtctcatttgataaattggattaagagtcaggcatcggagatagtgcactcacagatttgtagcttaagcaaggtggtgagagcctgggaagaactgagcaggctgcctggtgaggggccctgtgggccccagggactgcttacagggattacctgtcatgcaagtggatagtagcttctgaactctcctttagactaaaggtgcttttccccagcctccagtcttagaatttatgacttcactcatagatggttaaaaattgaactatattgaaatatatgcgttcaattcaaaaaagcctgtggacataaagtctttttaattatccctttctgtcctctaaaacatattttctattaacatatggtcagagtttatcaataagtgattccactaagtattccaaaagttccagggagcgagtgactgatttgcaattgtatcttcaattgattggcactgaaattagaactgtagataattgcctccaagctcccaaaacagtaaccaaaagacaggcataatactcaaagaaattattttctcttacaaacggaagcctctcatctatattttatagcccatttaacatttttgtgttattctaaaagtattctatccttagttaccctctgttgctgtttctcagtgttagccattagcagggccaaggcagttataactgtgtaagataaatgtcagtatgatttttccactccgtttcaaagtttctagcttctaagttgacttttctttctccctcacaatcttgtggggccgtgtccccgagcccacagagcatctgcaacatgtttctaatgtgcgtactgggctttctccacaattgtgtggcttcctactgagcactgtcaggtttaaagagcaagataaagggcacaataatatgtcttcagatgctgcactgacatctgtaggcgtctaaatgtcactaacgacaaggcatttttgccccaaatgcacagccagtcttctgttaagcccattcagtggcatcccatctggggggaattgggtctcagtgtggagtgagtaggaaatgcttagaaccacgagccgatggctgacctgggtaccaaggtcaaccatgtttggctgaagatgagtgatttgaagctcgtggaatataagttctctcccagagcagcagatgctgggggaaggtgacagttgagagagcttgcggctgatgagcaggccgtttgggggcatggaaaaaggagggtcagagaggccaggaacgcagggaagaggaccatacaggccccccacataagcacaatcaccagagagcactgcctgtcatgagccaaggatgacccagagccccaaggagcagagacaagggtcttgagcaagaagagggtagcctagatcagctcctgtgctgggaactgtactcggggttggccttcatgtgatgcccaccgcgtaccgcatggagtggtgggggcatccctgaatgtatggggctggatcgggtgagactggctagtggaaattgttgcagaggactttcataagagctacatatcagggaccgcagattgatagagcctgcatgtacacatgttttgttaagcctgtactgtgttttaataacatgttgagtttagagtgagagatttcatataaagtctggatttcttactggcctggagaaatcagacgtttgacacccctatacaaagcatgcatgcctggccttcctctgctgaatttaagtaggagctgccccctttcagtgtcccctttcagagtctctctccagttccctccagtcctcaccactccttattgtctcctcagtgctgaggctactggtggataccagttattgtgcttacaacattgcttttcttatataaagaaatctttatttttctcaagtctctatcaaaagtgggaaagtaaaagatggggcaaggaggtggtatttttgttttgttttacagctgaacgactttattaatttacataactggctcttgtaggtgcatgcgttcattatctctgctgtaaattgccagtatttccccagaatattcacactaggagccattaaacatctaaactctctaccactgaacctagaaggaagggaagaagaggaattgaagatgaaagaatcaaggcaaaaggtctgttgctgagaaggaagaagtggagaggagtcagaggcatgctggggacattgatccagaaaagattcattgctaattgtacatatcccagaggttaaaccattttctcgaagggtaagggaagagcatttctttgtaaaactaaacacagagtttcccagcattggagctaagactctgcactccctccccacctggggtggatgtgttcactccccctttaagcctgtggcatgaacaggcttccaaggttcactctattcccattttaagaattgatttgaactgatagttccaaaaataacttcataaaattatacaggagagccaaaaggaaacaatttcagacaatcagagcagcatggcatttgtcaagttgactagatgcaggaattttcaactctgaaaagcccatagaggtggttttccctgggccttgggtccttgacaccacaccagccatggtggctcaaaggtagcctgaggggtctctgagctgctgtcattagtttaaaaacctgagtaaaagtacattggggaaatggggatactgcccacttcctggattttttgggggtttcagtgagatatgacgtgtaaagtcctacaaacagtgtcagactcatcataagcgatcaatgaactcttcactgtgccaggccacttctcaagcaccaattccacgctgcccagtgctctcccaacaagtctgcctaattgttccaagattcttggcttttgctgagctttataggtgctgacacagattggtagacaaaatagttcaaatcaaggaaaaatagcatggaaaggggtcacttttaataaaatatttgggagcatggacagaaacctgaaccatcagcacagccctgactgggagccccttctgcagaccctggagtctatctggagacaccatcctcattcccagtgcccaggaggcaagggagcatagctgcttgttacatgctgagtttggggctaaagtggacctggattgaattttgtttctgtctttcactagcgctgtgtagctttcagcacattaaacttgctgagccttgatttctgcctaacagggaaatcataatagtgtctgctttataggaatgtcatgaagttaaattagatagagcatgcaaagcatttatcatagtacctggcattgtaggagctctcagtaaatgacattattgttactatttgtctctctgtgtatttgactccttgtagaaagatggccaaagcctcctgttaaacctccttgatcctctcctaaccctccatttgtttccattctgggggtgatcccagttcatcactgatttgattgatggcatagagatccttcattgtgcctcaatgaagaaaccaattcttctagatacaatttatcagccaatggagagctgttactgttgttattatttgtagagtgcaggtaggtgaggacccttctccacaaaaaaggaaagagatgaaaccaggttacccaatataaaacatagacttaatccgaagattgtctgctcatacacaccctgattttcatttgaaagaccctttccctgttatgtcctgtccctagaatcaacgctccccctcatgctcagaaagcaccatcacagagtaagactctggggtcttgtgatattgggcacgtttctagagttctctgtgcctcagttcattcactgtgtaatagagaaaataacactactgactgcattgggttaagtgagttactgcagagagacactgcatgtggtacttatcaaatggcaagcgctaagaatgacagctactagtgctttccttcccttttcctccctcttccgctctttgtcttcctcatcatcttcctcatcaacatcgtcacccaggccaagtgtgcaggtatcaggcccaaaggtgcttcacttcagctttcttattttgcttcttcaggctacagggaagcatcacctatggtgaatacacccctcctgccccccaatttttcttttaactttcagtgtcgtagtttcaccttttgtgcaatgccaaccccagaagcaatgatcagtttgggtgtattctaggcatgtttgtgccaatttcacagagcacagatctaaattcacgtcctggttccctccccctctggatatgtgtctgtgccaaatgatgacgtaaaccctcagagccttaattttctgatctgtgaaatggggatactgcccacttcatggatttctgtgaggtttcagtgagattctgcgtgtaaagttcgaacagtgccagacttataataagtgatcaatgaaatcttgactgagccgggctacttcttaagtgccagttccaccctgcccagtgcccatcctgagctgccatccaccaatagggaagtggtgcaggctgttgaatctcattctcttgtgttctttggtttctctcttaggaaaagcacctcattttctgcgactccaaaacgtggaggtgaatgtggggcagaatgccacatttcagtgcattgctggtgggaagtggtctcagcatgacaagctttggctccaggtaagcatgagagaagcctctgctcagactcgttaggatgagaaagggaaaagaaggactggaaggaagcagctctatggcaacacaagtgtattgaacaaagacatgcagagggggacaacagctagcaccggagcccacccttgcttacaaactggggtaattataggtccaggcgggagaggtctgggcttgtgagatggggtgggtggtgtggtcagtcgctggtaagtgaggagtttcctggggtcagatggttaggcctgggacttgtctggcgggatgtgtctcatggcccaaacccctgcggaattttctgctctaaccagcatttgcaaaatggtgtgagtttacgaaatggggcagcttgggctaacgatgctgtcttatcccttgataagggaagaaagtgtgtgctatgatgaatggtttggtgtgtacagggaagggagatttttaaagtacttctgttcctctgatggtgccctgcatctatgatcttgttaaatcttaactacgattctgctagtcaggcattggtataaccattttatacatgcagaaacccagaccaaaacctaaaagttccagaactagaatttgtaactatgaccttttccaactaccctctaacaaactttgtcttttaattgcagattactagggctgaggcaaatggaatagcttaggttcttggtacgtggttgtcatgtaatcttaactggaaggttcttggatatccagtgattcactggtacttctgggtaaaattagagagtcgctttttatgggaatttttcactaaaatgagcaatctgtctattctttggttaaataagtccgttagtaaagtccatcagggaagtgtttgaagcttgaatttgccttcctgttatttctgcttgttcatcccactttccaagaaagatgagaaaggatctctttgagtgggggttaggacagagggcgacacatagaactaaaacgtaacttgttataacattagcatacttccattaatactagcacaaatagcaagtttttggggcagcacagaagttggagccatgctgttcagtgcaggaaccactaactacatgtggctgtggtgatttgacatgaaaataattatttctatagaaaaattagctgggcgtggtggcgagtgcctgtaatcccagctacttgggaggctgaggcaggagaatcacttgaacccaggaggcggaggttgcagtgaactgagatcgcaccactgccctccagcctgggcaaccagattgaaactccttctcaaaaaattatttctaactagctttattgaggtataattgagatgtgatgtttaaagtatataatttgataagttttgtatgtttacatgtgaaactattaccacaatcaagatattgaatatttgcatggcgtccaaagttccgtccccatgtgtaatcacttccttctgacttccccactcccgtttgtcacaagcaaccgccaatctgctttctgacagtatgtattagcttatatgttctagaattttatataaatggaagcatgcggtatgtacccttctttcctacagaattattctaaggattacttatgttgttgtgtgtaacagtatttcttacttttgctaagaaatatttcatagaatggatatactactatttgtttatccatctacctgttgatggatacctgttgggttgttggcagtttctggctattacaaagaagttgctgggagcctgcatgtgtgagtcttcgtagagacgtattctttcatttctcttgggtatgaaagtgaattagaagtggaatggcagggtcatctggtagatatatgtttaactttaaagaacaacgagctgtttgaaaaaatggttgtaccattttacattcctaccagcagtctatgaaagttctagttgctccatatcctcaccagcactcagtatggtcagtctttttaattttagcatttcaataggtgtgtaatgggagcacgttatagttttaatttacatttcttagaggactgatgatactgaacatattttcatgtgttcctttgcctagctgtctctccacacactttcttggaagttcatgttgtcacttcttttcttgaatttaagccatttcctgtggttagaaaaatccttgggcataaagagcccatctagggaccaacagttcttccttgccacttagcagcaagcagagtgcaaatagcagcacagcagcgtgaaatacctgttctttctgcttcccagggttgcttacagaccacaggagagcataagaaacctccacgtcacctcagtattcggtagagttatttactcttttcattacgattagtgttcaagtgtattaggctgccaagaagctgtgtgatttcaatggcattgcctcagctgggtcatgagaatgaggcaggaccatcacaatattttcagcaactttgtttgggttttccaattattttatgatcgttattgtggcagttcttagttgcatgccctgaaccttgggtttgtcagtgggaggatgttaaagagatcataactgaatatttgaagaaaacagatggaaacacatgacatggagctcttccacatcttatctccttttcaatgtaaaccaaatcttatttcacaaaacgtcttccaggtggctttcaatgggacataaaacatgacaagatatcataaattaaaagtgggacaacaccagatagaaggagaaaatacacagagctggtaataatgcgaaaaccgcatttctgcacacgttactaactggtgggtcacacacagagcccgcagctttgtagccactagtggaataaaggaaacttgtcagatacacagttcacaatgtctgtgagataaacaaaaaccaattgctcaggaaaattctacctgttgttcacacagaagccagacaggaattgttcccaggagtccctgtgaagaaaacactgtatgatgcaatgaacaatgttccccaccacagtcttactgagggcacacaagtgagtttcacaggcctgtttcacatcatgatggctgtgagaaagcagtctggggaggagaagggggagagaggggtgaagtgggcaagaggctatggcagagtcccctgctctctgccaatctgtctccatcctggggcacttgaaacgtatctggtaagtgaatagattcagtaactattttttcaaggaaacttccctaaatattgtctgtctcatctgcatttcagaaaatattgggaggtacacagtttatatcgtgccatctgacaaatgcctgtgtggctagttaaatccaggcttatgtgcaatcaggtaattggaagtaggctgtattagtcagggttctccagagaagcagtgtgtgtgtgtgtgtgtgtgtgtgtgtgtgtgtgtgtgtgtgtgtgtataattttatatattttcatatataatatatagtatgttataatatatatcatgtaacataattatatgtaattatatgttatcctaagttatgtataattatatgttatacatataacaaattatgttattatatgttatataacatatataatatataaaaatatataattatatgtaatatatttatgtttaaaatatatgtatatataaatatataatctttatatagcactcattaaagaaaatatatattttataaaatatatattataaaaatttattaaatatattaaggaaaatatttatatgtaagtatatattaatatatatttgtgtatatatagtttttttaataagtgtttccttatagatgtaaacacttccatccatagtaagtcttttccttccatatataatatgtccttcctatatggaaggaaaggacttagtacaggaattggctcatgtgactgtggaaactgagaagtctcatgatctgccatctgcgagctggagatccaggaatggcagtggtgtaattctagtccaagttcaggagaagaccactgttccaactcaagcagtcagggaggaggcaaaggggcaaactcttcttcccctgcttttctgttctattcttccaaagattggatggtgcccattcacgctggggagggccatgcactttactgagtccactgattcaaatgctcatctcatccagacaccctcacagacacacccagacatactgtttaatttgggtactctgttacagtcaagttgactcataaaattaaccatcacataggttaacatctttctacaaaaagaaggcacctatcaacacacctgccaccccagagaggatcgcagccaccatccaagacaggccaaggcagtggccagtttctcctgagatgtttcttcagatgtgtccaagcagtagaggagtggctggcactctcgctgttgttctgcctcatataataaggttggggtgacttagcctgagaatttccaaagcaaatgaaacaggcccatcatggccaaaagagtctctataagacagctacagcaggtctactgtgtagcagtgctacttcctgctgtagcttctgagatatgctgaggaatttcactaagtcactgaaagtggtaacttctcaactcggccagttgtaattcagggaaataaagatgttgtttccagcatagcaggtatgtcggtggcccttctttctggcagtggttagaaaggagccagtggattcatagtttgagataaatccctgttgcctgtgtggtgaaatgctggccctcttttctgtagagtgggactttatagcttgcttttccttaagtggttttggatcataaattaataagttaaaaggaggaccagccaatgcccctgttttgcacccctctggaaactttatatgtctttagaagatcccatctgccggtgctggcttttgtggaattacagtacaagttctacatgagagtcaatggacaggaccgatgcagaaatgcaaacacatgagcctagaacaattgtagtgaatcagggaaaaggatgatagaaggctagtaaaaaattataagcaggttcttcttgtcctgggatcatttctccttgaggtgaagtgtatgatgccgtggtctgtggtggaaggggctcagtcataacttgcttattccttatgtgatactttggcctgaggaatccagacatgtaactttgcaagcaatttttcaagcaaggagatggtgtgcattccaaggggaatagccactaaacaaagtggtctacagttttgtggagtccatttaaaaaatgacattcaggatacaactaggtggggctataccaacataattataagtgtagcacagagcaaatataaatgtgtacatcttttctgcaagataattaggcagttgatatccaaagccttaaatatgcatatttttccaatgagtaaatttacttatggaaatttacctaaggaaatatctagagatggggacaaaaatgtatctgcaattgtgttcagtaggacaaaaggctggaaagaacctaaattttcagcaaaagagactgattaagtaaatgagggaatggtatcattaaatatcagattttagaagtatatttaacattttcataacatgtaagtgaaaaggatgagttatagagtcatataatattaagctttatgaaaaaatatatacacatatacatgctcatgtacataatatataaatatatataatctgtatatacatatgtatatacatagacactcctataactccatgaaatacatattaagacacttgattgtaataatagattatgaagctttttattttcatcgctattcttttctgttttatccaaatattctaagatgaatacaggaaactaacataaacaaaatgctattaaaaaaagaaaaatggtcactttttcccagttacagaatactcctagtatacgaagaagcctttgctgggtttggcatagctaattccaacagtgaggacacaggtttttcccacacccccatcatcaccatcagacactactcatccagaagcatgtttagaaatattttatgtgtgtcctcctgtctttatcaaggagcatggtggatggggctctttccttgaattactcagggactccagagcagagtctgtcagccccaccatggagctgactctcaggcctccctacaaaggattcaatccacgaggggtttttatgacaaataacatttgaagagtctcagaaatgaagccatgtgtccaaacgccctgtgcagatctctgtagggacagtgtatgttttcagacaaattgcattcactggactgggagcagatctgaatctcataggaaaaggttcctgcctgcactccagcagctgcaacagggttgatgagctgaggaggcatatcagtctttactgcagccggttcgcccagtaaacctgtttccttgctcctgcagggctgctgctggcctctgaggctgtgagtgttctggggaccagctcctcctcctacctacctgcctgcatctgaaccaggcatcccttctgtgtggcatttctgttgacaatctagtggtcacgctgcaactaagcaatgatgataatgtaatgatactatgtttaacagctgatgtttactaagtgcttacacataggatgtatttaattctcataaccagtctttcagttagatgtgattgtagccctgtttataggtgaggagactgagccttagatgggtagatgacatcctcggaattacacaggcagtgagcagcagaagcatggtgtgaagaaacataggtcctgtctctcagtcctgggctcattcttccatgcctacctcatggccctgtcaccttgggttacactccagcctttccttctatacaggaggctttctatttaaaaacagatttctttatttagcatatatttatacacttctaaatttattggccgctgaaccagatacttaagtatattttaatttctcaaatctacatgagatcaatgaaataaaatgcccttggaattatttttgaattgcctccccaccccctagttgccttcttaattctcttatccccttcctagccacattctttaaatgggacgtctacacttggaatgaggctttcttcagtgccacctcttccaaggagtggcccttgtaaatgtccccagtgctttcctcattgctatagccaaagggtgcatcgcaggccttatacttctcttttcagatttgatgatactgactgctccctccacaaaaatcttactgcccacttgaaactgtctatcaataactatgaaaggcctaagattttaccttatttggaggctcacaaggtagactgccacagtttcatagatgctggcagaagacatgaaacttctgggtcagagacaaagaactttgttattcaccacacagcaagcagcattaagtttcatgttctcattagtttcctttgtcccccaccaagccctgtgggacttatgccaggtccctcctgactctttgcaggagttctaaacccagaaatcaacccaaaatgagcagtcagccacgtacatagagggctcttggaagggtttcagcacagctaatcaaaaatgatttatgtctacttctatttcttctgacttttaataaagaataatcaaaagctattctttagagactgccaaaaaggtacaaatgtgatcttaagagaatcaatgggctagattttagcaagtttctaaatgtcatgccgtggcagcagggtgactagaagtgaaaagaatacgcattacaagtgaattgtgggaatttcacctaaatattttctggccaggaaattcctggagcagttggaacaaatgacagctggaaatgctgggcctaattttattttgttttatttttatatttttatctttatcatttttttttattattttgatgccaagaagttcaaaccaacacactgaaggcttccaggatcctgcattagaatatcttctgtaaaccaggcatagtatctgttgtgcaaaaccagaaatggtttccttttattaaagacagtactgtttccacttctgccaattacaagtcaatttcaaggcttcctgctctttctgaaataatgacagccatttttgtagtcttgtcttacctctttgtgaaggaaataatgtcatgacactaaaggagagtggatggggaattgcaaaatggcaaggccattacagaaaccttgatagataatcagacggtaggaaaacagcactctctgtggcatcaggtgcaactcttgccttcctctttaggtggttcctgaaaatagaggggtcttgcctgggggtggaaggatgcacttgtgctggggacagaacattaaagtgtagctattacagctcctgttcttccaatgagtgtgtgctctcaaaccaagccgacttatccacataaaacaaagtaagccaagggaagttggaatttgagttgtttttaaagagcaaggcaagcagttgaaaaaggggaaagaaaaagagagatttcaaaggcaacataatcagagaaacataaacataaaatgggattaagcagaaccaccgattaggctgtaaaatgcctttcttcaatttagaacatgtatccctcctgtacggatgaattggaagaaaaggggttcaccttctgggcagatgcagctccatagatatgtagcttgatatgcagatagagcccttgggcaaagcacaaaagtgacctccctccaagggggctcagtaaggactcatggctgtagtcagaactcctggctctgccaatagagtatgggttgggtttgggggccacaactcccgcctcttagctgggcactgttggtgcagtgaccagttgctcatcctcaggacatggtcttagatttaaggaatttttccattcatgtgttctgtggtattatttggccccttgctttccattaagggacttaagaggacatcagcttttaagtccttgagacccagggtaaagtcagcagaatttagcatcaccagggaaccaattagaaatgctaattatccagcctcaccccagacctcctaaattaccctctaggtgattctgatgcacattaaaatttaggaactactgttctagtctgaaagagtggggataaggaaacctcaccccaacctaatagtataccaggtatgccataacttaataatatattaaaagaatctgatggccaagaatataggaagatactctgttccttcttacatatatatttctgacctaaggtcttccaagatttccagaatgctaggcatctgggcttctatcacagcatttccaaaactgttttctgtgaagcagtcattttctgcaagttatcattagatattctttgaacaaacaaagtaagtttctggaacactgcactctctaccctcctttcacagagttgctaagtgtagctgtgtactgtttagtactaggtggcagatgggtgatgtgattaatgtctcagtgtctggtatcagatcacctgggtccaatcctaactcagcccctcagcaaagtgatatcaggttttgttcctcctagtaaggttcatggaccagcagcatcagcaagacctgaagaattccaatccccatcacaggccttctgaatcaagatgtgcatttttaacaagatccccaggtggtttgtatgctgtagtctgagaagtactactaaaagccatattgcttgaccgctctctgcctcagtttccttattcattaaataggaattactagtaggacttatctcacactttatcagacattggaatccccaggaaggtttgttaaaacaaaaatggcctggccccattcccaaagttcctgattcattaggtctgggaatttattagatggcgctagatatttcacttttttatttgttttatttttttttttttgagatggaatttctctcttattgcccaggctggagtgcagtggcacgatcttggctcacctcaacctccgcctcccgggttgaagcgattctccttcctcggcctcccgagcagctgggattacaggcatgcgccaccatgcccggctaattttgtatttttagtagagatggggtttctccatgttggtcaggctggtcttgaactccctacctcaggtggtccacctgcctgggcctcccaaagtgctgggattacaggcgtcagccaccgtgcctggcctgagaattcacatttttaacaatttcccaggggatgttagtgcagcctgtctggggaccatggttcgagaaccatagctctagatttttctaagagcatttctgtctccatgccagacctgttttcctccatgaagtatactatttcaatgctcgacttagtgtttatgttttactctttctactgtttttacaatcttaatccagcctataaattcctctgggcagaaattataccttccacactctttcattttctgttttgtaaaataatgagtacatcttcagcatgattaataatagaatggagaaaggggaaaaacctcagactatcaaccccagtaaacaacatctccaagtggatatcagccctagaattatcttacaaatttacatttctaacaagttcccagatgaggccgatgctgtagattcagggaccactctttgagaagaactttgacagggactttaagaggatcaagtgaacagtctattatgtaagccattaacacagtggctggcacaaagtcagccttcaaaactgttagttgatgtgacttttacttgataaacgctcagataaatcttgttaagttgaacaaaatgtttatcaagctcagctacggagtgatttatttatgtgagatggagtgacatttcataggaagcagtgcttaattacagctatgctcacacctggtattgccagtgtgctactgaggtcagttcccagccccatgtgtaaaaaaaaaaaaaaaaaaaaaaaaaaagcagatttagaaacagactgccagaaaatctcaaggcagtagctcattggatttcaggaaacccaacgtataatttactgtaggagaaggcagagacaggaaagtgccaagtggaatgcatgcttttagtgtcctggacagatcccctttgcaggcaagtgccctcaaccctagagcactgggcatgtcggctgctaaagcctcacagcttccttttcccagagagctgccctccgtcaagtaagaagtttcctcctctctctgcctcgtgagccctgaccaatgactgatggacacagtagttcaaccacaaggtaccatccactctggggtacacttcatgctccatgactccttgtgggaccaggctggagcttgactccagttgtgatctcatcctttcttagccccttttctcactctgtcctttatatcctttctcctgaaagcacttgataaatctccatgtgtcaaagtctgcttccagtgagcccaaccagagacaccacctgttggggcccactgggacatttgttgagttgactcgtggaatcagagggccagacgatgatttcactttagaacaacacacatattgacttgaaaatcttgccacagaaggaaaagaagcatgccctaaaagttcagaggaaggatatacttaaatctgaaaaactactgcaggaaccagaagaaaatttccgagaagccaagtggtagataagggccttatctgacggaatttttcctggacttctgtgtgcacacatccttgctatgcttctttgtggcatttcccaggactttgggctttccttcaatgtcttgctccatcttcctgacatcctaacatttgtatctctgtgcatttttatgctacctgatttctgggtttcaccgtattagccaggatgatctcaatctcctgacctcgtgatctgcccgcctcagcctcccaaagtgctgggattacaggcgtgagccaccacgcccagcccagtttcctcttatatatgacagcgataagaagtgtgcctaccttatttttcatggggaataaatgagaaagcatataaaacatttagcacatagtagtgtttagctgttattagcttaataaagaaaaaataaaagtgtttatgatgttataaataactcatattagaaaatattgagccaaagcctcaccactaactcattcttatcccccatggtggccctgaaatgccttgctcagcagtggggaagatgggctccttttgatgaccccctgcttccaaggccctcctattcattaagtgatctcttctccaaatcaggatacattcctggtgtttgccggaattttcccgcctttctccctgcactactttgggaatttccggggcattgcatgtggtgtctcctaggttctcatagtggggtccaagttgtgccatctcctgcaaagatgcctcaaggcatgaggaagctggatggcagtttccgcccaagtgacctttctccccttccattaccttgtactggtttttattcgggcaagcgaatggaaactttccagctcagaacagtgaaattgcctgctcaagtctgcatagcttggaagctgcagagctggcatttggcttcagattctcctcttacagccccatgcatgttgctctgatgtgtactaactattccacatgttggttagtttctggcatgagagggagttatggctgcctctcattctgccatggcttttgaacaataccatttttttttatgttcaagtataaagcaaatacgtgtttgagacagaaagtttgaagaatgtgaaaaagtaaaaagcagcagcaaaatattacctacaatctccctgtagcctggagcctgtagcctgtagcctggagcaagtctctcttagctgccctttgatgggggcctgggataccctgggtttctggccttcatgatcactgccttcccctggtattggtctcccctcatttgctgccatagagctgagcagtgtggctctacctgtacctgtgcccctctcctgacaggtcactgtagagggtgaggaaagatgacatagatgaaagtaggttatgcacatggggaaactgtttacttggtgcaggaaacaatgaagatcgcgttgcgagactgggagactcagggcatgagaatcataagtcataaggtttccctaagtccagataattaaaggagtcaatttcactttttggggaaaaacgttttcaaattaaagcaggcactgagaatatggtcttagtaaaaacagtgcttgacttgaagttggaaaacctggataaggggcttgtgtactctacacatttagttaaactgttagacatttggatttttcttctgagaagagcagcagttgtacactccccaaacaaggctgtgaagacacaatgaagatttatacaaaaatacccagctcaggggctggcacatagtagataaatatccagttaataacattaataaacatccactcaaactgcaccaacatgcatgtgccttaccagttctcataacctgcaactgtgaaagaggtttgttcaaactcaggatatccctcctgagattcaggatgctgaagacaaaagcccacgtgtattcaccttgattctagagatgtctaccaacttgggaagctttcagacaagcttctaaagatgaacagaggaaagtccttcagtgtaaaatgggcaacacttgtgggcaaatgtgtgtggaaagtttgtatcatacatagataagattccagagatggtgtgacagttgtgagaactgactagagatggctgtgagctgaacgtggctttttacggaagacggagtgtccccagggagaccagaccctccaggcagagaaaagagcatgtgccaaggaagagaggtgttggaaggctcccatcccctccctacctgtggtgatagcttagggcaggtggggctcagagcctgtggggtggggtagcagggcaccagccacagggcctgtgagccaggcggtgtttattctccatgggctgggttttcactaagtctgctgaagtttgtctgaaagaatgctatgagttctgcttaagggaaaaaggaaaatagggaggaaagttaaggggctacatgccagccccaaatgcaggctgagccaaagtgtttagaaggagcctttttcctctcttcttaccaccaggcctgtgtcctcaaatcagctcactagcaaagtttattcttgaatcagctcattagcacaaaccagccatgaaaactcctgcccttttttttttttttttttttttttaaagaggcagggccttcctctgtcacccagggtagagtgcagtggcttgatcatggctcactgcaaccttggtttttgggctcaggcgatcctccttcctcaccctccagagtatctgggactgaagatgagtgccaccatgcctggctattttttaaaatttcttgtagaggcaaggtcttgcttgctacctaggctggtctcaaactcctggcctcaaatgatcctcctgcctcagcccttgcaaagcactgggattacaggcatgagccactgtgcctggctggaaatcccttattatagtggaaagtcttgagccccaggggtgtgaggatgggtggatatccgtgttgggagtcacctagaagcctatgatgctatgattcctcctctccctctcttcctctgttctgcagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaaggtgagtgcctccagcctgcgcctctactgccatggaaggttggcattaatgggccttaaagccccttttctcatctgctgatcctcccccacattcagtaaaagaggagattaatttctagtcactctggcctccctccccaacacaaactccccaaacgggagaaactatggtaaaatcatgcaacattgcattgctattccaacttgagtctcacatacaagagccatacgtgaaagactgtggaatatataacacagaagacatcttcaaatttggctttattttgtatttaaagttagaatgaacaaatgtccttgtatttgggtggcatgctgtggcagtgttctcgtactattgtttctgagggatttttttttaaaaattgaaaactcaatacaatgacaatattttggaaggacttttgaaatgaataattcctcaccccactggccttgattcaattcttttcaattttcttgttcttgttcaccttgagatactgtttacatgctttccattaaaatatgcagattgttttctgcttctctcaaaaagccagatatcccatttctttctgcaactttgtcatctttgttatgatgcttagtgatcgtatgctatctcatccaatgagttatcctattttgttaaacccccccatttgcagtcatttcgataattccaggtgtcttgtttttttctttcctttgtgtatgtaacaattagcacctccatggagttcttctggagagaacattttattctattgaaccagattatttccttaggataaattccctgggggtagagttgggaggccaagaatatgagcatctttatggatttttctttgtgttgcaatattgcttttgcaaaaaaaaaaaaatggtttgacagtttacactggtaactgcagtgtatggatgtactcattttaccaatgttatgtttgccgattaaaattttaatatagcataatttagtgaatgaaataatgaagcttttcttattatgctagctgtagaatgagacctggtgtgtttgaagggaaaaaacaaaaagcaaacaaaaaaaaccccactgatcgagcctttgaggcctcctaagttagtttcctttgtcaaagtatgggtgggtgtggaaactttgacctcattttgctgacccagtgtgactgggatccttgggccaactggactgggggttgcaggctgggattctctatgctggctgtcttgacttcatacagacattcacatggctgatcatgtgccatcattcaggtctcagctgaaatggcagtatgtcgtcttctcccagagaacttccctgaccccccgcccacacctcccttcctggtggtcacagttccttctcattacctggtctcctcttccacatagtttttatcacactttaaaatgctggtttgcctttatttgtttacttggtgactttttgtctccccttttaggatctaagctctgtgagaggagggctgtctgctgggttggaagtccctgcactcagcgcagtgcctggcactggttctcagtttgctaaaccatatgaagtgttagtgttcgcctgttttgacttgcacaatcagtcatttcacaaggctcaacttgaaaaaatgtgtggactgatagaagagtgaatgaattattggcctcagcaggagtttattatttcctcaccacaatgccatgaacacttaagccaaagatcaacaagttaggcacttatgaaaaaaaactttaaaaatctttaaatttgtttacattaaatgttattaacatagaaaagaagccaccactttgatggcattaagctcctatctttgctttgttgatgccataagattaatttgtgtggcccggtatggtggctcacgcctgtcatcccaacagtttgggaggccaaagcagacagatcgatcacctgaggccaggagttcgagaccagcctggccaacatggtgaaaccccgtctctactaaaaatacaaaaaatagctgggtgtggtggcatgcgcctgaggccaggagtttgagaccagcctggccaacatggtgaaaccccgtctctactaaaaatacaaaaaatagctgggtgtggtggctcgtgcctctagtcccagctgctcgggaggttgaggcaggagaatcgcttaaacccaggagacggaggttgtggtgagctgagatcatgccactgcaatccagcctgggcggctgagcgagactccatctcaaaaaaaaaattttttttgaagatttattattattatatttgtattatgtgacacaggggttattgcaggccattcaggttctcagtgaatgtgtattttcagatgtcctgctggaatgtgtcttataccttccgtggctggtctcccacaccagattgagagtcccaggagagggtgtgctgtgttcattcccgctcctcatggtcttgctagcaccttgcatgtacatggggcaaagttggtggcaaaagaatgtgaccagtggctatgggagttagtttagcactctgaaattcccatgagcagacaaatggaaccagaaaacgcttggtttattatttgcttatatgcccccattcaggggcaggatgggagctatgggaagagaaaccaagaggctactgggacagaggatgtggtggagcatccttgctttattcggagaggtggccagggtttacggggacactgatttgtcctctgctggttgtgcatcctgggcccaagtcaagaggaggggctggtgctagcctgggtgcagtagccaggcctggcaatatgactccgcagctaccactgctctgaagccactcacctgcagcccctgccactccagcttagggagggtggggtggtgggtggcacccagtctccttcacattgaacagtggggggttggcacttcctgtaatctggtcaatcaaggtgtaattttattacacatcgatgaaattcatccatatttttggcataggttatcagttttttagtgcccatttttcctccatttaaatattatgatggtggtaagctaggagcctggtcccttgcatgtaaagaagtcccttcaacatatgttacctgattttttcctaattgcagctctgtacattggttttattttaactcatttcatgagtgggagaattagcacagccaggttgagaaacaggaccatcccaaggggtacaactggagtccgacctgcatctggctcatgctgtttggtcacacctggagggctggtgggttgtggtcttgctgttacctggtgccacaatgtcatgagcagtgctgaaggggcccaggtaccaggcaagcaggattccctgggtccgtctagctaacttgccattttgacacgtgatattcccttcctgactgtcagctaacttccagattgctggagaaatacatttaacctaccctcaccccctgccccgaccccaaacacactgctaaagagttagtggcatccaagcaaaacaagaaaataaaaggcagggaccccctcaggagcagaagcaaccagaggaaacctgtcaccctggagtgggtgcccagggacccatttgaaggcagcaaacccaagcgtttggaagaaactgtgtgatgaagaatgactcacttacctctcaagagccctttgcctttgcggagccaggatgcttaagtactttaatactgaagtatttgtacttgtttaaaaaaatacaagggaaaagcattaatcctccttctttcagagaagggagaaaatctgaaaaacagaccaaaaaagaaaaaggattctcaagggccaagtgctgtgttatgggatgggatctggattccttcttggactgacatcacccacaaccctgggatatcacagaaagaaaaccatgtcttcaaggtcttcctcctcacaggttcccaccctttggttccagttcagggcaggagataactctgcagccaagatgcttgggtctgaattctggccccaccttgtcccaactctgtgaccttgaacatgatctaacctcttggggcctcagctggctcatctgggaacaggaatgtaggattacctccctcagaaggcgtcatgaggatgacatgtgataatggatgtaggagttcttagaacagtgccctgcataggcactctaaggtatttgttaaataaaataaataaattgcccataggggtgggatttatcagacaaagaagtaagagagatgaaggactccatgggtggggacaggacattggacccaggtgccgatttgatgactgtctctgtggctttggggaaatcatgtcaggcctgttctgtaaagtgtggcccagttctctgttggtacacggtgatgtgccgagtataagaagagggagggaggaaatatgaaagtgtggactgggggacatttgggtcatggggtcttttattagggttctctagagggacagaagtaataggatatatgtatatatgaaggggagtttattaaggagaactgactcacatgatcacagggtgaagacccagatgggccgtctgtaagttgaggagcaaggaagacagtagtggctcagttagagttccaaaacctgaaaagtaggaaagctcggcagtgtagcctttagtctgtggccaaaggcccgagagcccctgggaaaccactggtgtaagtccaagactccaaaagccaaagaagttgaggcctgatgttcgagggcagcataggaggaagacgaaggcaggaaaactcagcaagtccgcttctttcaccttcttctgccggctttttctagttacgctggcagctgatgggatggtgtccacccacattgtggttgggtctgcctctcccagtccgctgactcaaatatgaatctcttctggcaacacctagaaacacccagatacacccagaaacaatactttgcatccttcatttcaaccaagttaacacttaatattaaccatcacaagtccctgtaggtcagaattctctggtcctttcctgtgttcacccctactggatcgggaaagctgattcccgggtctggggacaaaggaaaagtagctagttttgtttgtgctcagccatctagttacatggaccacccctctcctggtattgttcattcaaaaccctaaccactccacagttgggaggtcactgggcccttcagcacccgagggttctgggagctgtaaacccctgtgctggcttccacagcaggtactcaggctgagaggaacagcagaggcccaggctggtctctctttctccccaaacaggcgtattcatggctgactggctcacagctcacgtgtgatcctgagatggtaaagattagcacttcagaagatgctgcctaatgtgagggtaggtaatatcaaattctcagggcgacacacagaccgaaatgaaagcaaattggaattacttaattctggggagctgtttattgagttgtgataatgtacctgggtatacattagattactctgtaattgaggtttcgctcaattgacaattcggcccctcaacctacctggtccagaccagtgctcagcaaatgcttattcatttgctttgcttctggttttctgagtgtcttcaatttcaaggtgtcttagctggcctcaaggacttgagtgtctgcaaccaaagttatgcagatgtatcttgatgaaaattttctaattcataaaaagtttcttgtcggtggtgatttttaaaccaatctttcaactccatttaacaacctattatgcactcagaacactcatcagtatgagaattagtgctcagaagaaatgtgatactagtgctgttagaggttccgatttaaacactgatgtgacttcctaccaagggaggttgttaggatcaagagtagggattattgttctaaatacacttgagtttccatcttagtcctgctccctggtacctgtgtgattcagcaaatcatgtatttactctgggcgtcattttccttatctgaataatggaggtgaatatatataaataggtcctatgagagggagaaaatataacatacatataatatataaaacacatatatatagcataatatatatgtaacatatataaacagatacatcctagtactagaaagtataaaattatgtctttagtagtaatcatattttttacattactattaaggaatgtttcccaaagacattgtccattgtttgttttcctggattaaaggaatgatattctgtacatactatgaaaatttaaatttagatcatcttaaggtctccctcttctgaaatgggattgaggtcatccaatccaatccattgtttgaagtcagttgcgaaagtgctttacttacattgtactgtcttctctttcctttttaagttttttttcagcatttacaagtttcttgagactgtatcaggcatagctacctggagcctacattttaggatggcaacagtgggctcctcagcgtccctgttttggaagcacacgttccaccgttgactgctgtcctggctggtcccgttttgctctctcactagtctggtgccagcagtgatttgcatttatagcctctagtttaaagatggaatgcctggagtagctgactcattcctgtattcatttgcttaataaaggtttatggagcccaactgtgtcaggttctgtaataagctcatggtctagcaggaagaatcatgcaaatctgtgctgcatggtcagttaatgttagccacctgccacactacctccctaatcctaacaatggccctatgacgtaggtgctgttagcaaccaccttttaccagtgagagcatggaaacccagagaggttctggacctttctaagatcatactgctcataagtggcagagctaggcttgccttgccttggccatgctgtctcttttataccacatttcttgcaaaatccagtatggtagaccctgcattcaggtgtgagctaaaggtgtacagaggttggaacaatgagcgcagtctggaagagtctgggatagcctctccgactggccccatctgagatgggtcctgtggcttggcaagctcataagcaggacagcctgggttagttttgagacactgagtgggtgacatgtttggggctggataagtaggcaaggggacatttgcagagtctttgtaccagaataggagcctgggcttcatcctgtagtagtctaggggctgtgacggaccctatccatggccatggatagtagtgtgcacactcataaggtgggatctctgcatccagctgttcttcctttctctggtcctgcagggaaaaaccattgtcagacagctggctatggtcactggcacagactgcgttggaaaagaagagtgaagataaaaggcacatggcgttgagacccctagaagcagactcagggcaggagttccgagtgcaaggtgcttatttggttttagggacatgagacagagaatcaagggcagcgaataaagggtacattctcaagtgagtaactgctgtgaccgtctggagctctatcctactaggtaattctgggattcagtgtagaacccctggggtgtggaggagggggttatttgtaccttaaccccctccagtcattggttgagagctgctcttgggggtcttaattttctggctttactgtcttgtcatacaggatgtaaccccccgctccccagggctttggcagaagcccatgtctattagctatttgacagttggcagaggcagttggaggttggactgcactcggtgcaataataagtcctgaggtggcggtgggacgcaacagcttctgctacagggatcctacagcctctgtggccttctaaggtgaccaaggctgctggctcctgcctccttggtggcagcagccatggaggacaagctcatgctaggaggagaggcaaagccaccttgagctctgtgcttgtatagggagtggaacaaagcaaaggctggcctcagactggactccagagtttccattcacgttctccacaagtcctcagaagtaaagaggagctggagggctatatcacccagtgatcagagagcaggcatggtatcagagagcctgggctaacatctggcctctgctctacctcctaagtttatctagagcctgccaccttccaccacctctattgtcaacatcctcgacaaggttggcagactttctctccagggcattagagtcaatagtttcagctttccaggtcatatgatctgtgtagcaaagactcaactctgctgttgtagcaaaaacagccataaaaaatatgcaaatgaatgagcatgggttatgtgccaataaaactttatttacagaaacaggcagagggctggatttggccacagtttgctgatcagtgcatgagtcaaaactctattctgttctcaactgcatgactattccagcttcctccctgctccactcttgccccattgatgtctattctcaatgcagcagcctgagtgatcatttgaaaaagttagataatggcttttttcctgttgaaaagcctccagaatttcctgtcacactcagaataaaatccaaacttcttaacatggtctccatatctagtccttgatttgtaatgccccacccccatatttgccctcttattctcttttctagccatgctgatccatttcctcttccttgaaccacaccaaactagttctgacctttgcacttgctgtccttgctttgcctgacatgcatttcttccagataattatgtagctcacttgttttatcgatctggtctctgctcagacttcagcttctcagagaggccccctctgattaccttatctgaaataacactctcccccacctcccaccccttccctttgtaactctgttcctttgcagggtgctttggttttcctcctagatcttgtcactatctgacattgtaatttacatctatttgtggattacccatctttcctactagaacatgagctcctggaggaagaagctttgtaagccttatttcctgctagaccagcagtacctgagtcagtacctggcatatagaaggggcttaaacatttgctgtatccagggaagagtgctcaggtccttactttacaagcatgtgacgagacccctcaccatcccttcttttttaaggttctcgttattgattgagctcctggttttccttctacctctgagaaagttctgtctcctttataggtatctgtttctttaccttttcctttaagtattacgtttccttaattcttttcttccttcttatgggagctgtgagctttgtaattccctgtgctcctcttatggtctttctttgctctgatttggctacaaatttagggggctcagttgccctgccagagccatgctacttacccaccccaccatgtgccccttagagtggtcattttaaaaactcctgggccttcttcaatgccttttcaaggaaggcttgcctcagtgtgagttctacccattcccccaagagccctgcatatggatcatatatgctccaacttaggtctggaagtttttttgtggtagacttagcttacctcctcctctcatctcatgcctgatcttgactttcctggaaccctatttcaaagcagagaaacctcaacatgctcatcttctgcgtgagtttcattctttgtaggaaaatatgctggtgctttggttcttattttttaatctttctttggtcttaacttttattaataatacttgcatcattttttttcccatgactgctattgtcaagaacacatagatagcaaatcagaggtctcgggttcaaatcctgattctgccttgtgttagctaagtggattaggaccatcatttcatgactgcctaattggaataataatgccggctcccctagatttgggtcagaggccatggctatgaaaattgttcctaaacaaagtgcgtgcctatgtttgtgcttctcctcatcattccccatcctcctcatgggtgcccggttccccacccttagcctctgactccttcactctttgataacgtcaccattagctttttatggaaagagaaaaatgacagatgggagaaaagtgggaaacttcacttgaacatatgtgtggaggggaggctaaccgggagatattatgtatattgtaatctatatgggcacaaagaccagcttatttttaaaaaagtgtaaatgtggataaataaaacctgataagtattggtttccttgaattattttgactactttatcagctgcatgctgatgtgttgcattaacacttttaacgcatttggaaattaaatcaaatggcaactgcattaaattctcattcacttggaacattaccctcctgtgttcaaatggaagaatgatctgaggtatggaacaagctgcaaagtctgtagttagctaccatttgtggaccatttattgcatgccagacacttcactgactgtcttctcatgaggttgtatttaatcttcaccatggtcccctgttaccactgaggatgctgaagtctgattacccagtctcatcagagtcacacagtccaaggcctgccctcttcctataatgagcccataaatgagactattttctgaccctccttatgctaattttccataatgtattattccgtgacagatatatatggaatattttttctgagaacccaagttccaggctaggctaaactcagttaaacccatgggctccagtttagtaagaatgctctagatcattgcctttgtccagtcactggagcctaatttatctctgaaacactgcagcctctgcctggaccagtgattcttaattgagggtgattttccttccaggggacatttggcaatgtctggagacattttggattgtcacgatgggagagggggggtactgacatctagtgggtggagcccagagatgctgttaaacaccctacgatacacagcatggccccctgacaacaaagaatgacccagctccaaaggccagtcgtactggcccagatcctgccccatgggaaggcttttgtacttagtgccctactattcatctaggacgccaggtgcagaaactggatgggaagatacttcctctgtgggcctctggccaatggagctgtatggatgggaaggcagagctggtgacgtggctgtgaagaagtggttccacttatttgagccccagaatccctttctggaaaattgacatatgtcttctggtttactctgactagtgatgcttggccttccctctgccatttccccactaactatccagggaaatacagcaaaaggtaaatgcagactgactccccatttccgagatctgagagaaattttctgctacctttcaggccaataaagctggccaagtgcccaccaagcacatgtgcctcccttccataggataaagtggtgaagcagctgcctaaccacggacctcattcccagcctgctctgcaatcactagggccctgtgataatagttccagtttaaggaatgtgagcagaactgctgcatgtcctttcagagtcaaagagttaaaaagcatgtagtcattcctcatctgctcacccccctctttggttagctggatgcagacaatttcaaggtgaggggagagtcaaaagattgaacacgcctgggtccctgaatcaccttgtggaggaaaattgtctgctaagcaggcctgttattaatattgaagtgataataaactattattgtgttaagctactaagccttggggtttatttgttacagcaattagtattttcctaattaatacaatttggatcaaaaaaagccattagaaacccccacaggcttaatgtcttgaatgaaaactttctagcctacctgaaaacagatgggaagatgtttcttcctttcccactgatattgggcttaaacgtccaaattctgtacgatctgaaagctgagcaattatctttttcttgtcacgtattgattgtttttgaagatttttttttaaagtctcctcccaaatgttctttcttgatgtagactttacaaattccagaatacatgagggcaaaaattgtgtgttctgtgttatgggaaggggttagagacagacttggctatggccacgaagcccaagaactacatgaactcaggtagagtctggccagatgtggcagcttggaagtctgatcctgaagggtaggtcttgcactaggagtcggaggactggtgatcctcctgtcaggcagggcctggtacatgaggtagggtgtccaggtgaacagtcccagccagcccagctggtcatgggaactgtccttgtacctggcctcacccagcttccagcccaagccagttggtccacctaccggcaacccagtgactccaaccgcaggtgggtgggtggagaaaaggaggtagagtaaaagattttgcagttcaaaaacaagcaccgccaatcatttagaaaggattctcatgaagaaatcgtcgcaacacattcaaacattgaaaaaacaaaacagtagcaattctcaggaagcagatgccgaaaacagccgtatctcaacagttggggtggctgtgggttcccaatgtaatcgatgaggttcagtatgctcacgttgtattgtttttaaacttcacccatgccccttgcacaacatgtgctcattttgatccagggagctcagaagccgtgcttagcggacatttacctaagaagagatgtggccttcattctcctgctaattagacttaagtgaccattgctcagggccttgacttgactatttgtcaaaataatgggttgtattctaaggccaggcttcacgcttattcccgccttaaaacaatggaattcctttctaaaatagtataaaaaacaaacgatgcagctctgcagaatcacaaggttcctagaatagaataaaatctctgctttcccacctcttgggcaggtagatttctttgcttctttaaagtttcttttttcccccctaacccatatgatccttctcctttttcatgctttcctaaacctggtagaaaaggaggctaggatttggcctcttctcttttaaaatgaaatgtgcttgcaccagcttttcattattaatcagagtagcatgcctgttgctttatatgtctatccaggggcagatgtgactcactttcaacccagtaaatggaaactgtgcctttttgatggaatgcggcctggtggtacggagcaggcagttattggcagagcagctgatcatctgttctcagtgagggaaagcctcctgtttgagttaatcagcggcaaaatgtgctctgtggtttgttcttttaatctcttctgcacgtgagtgaggaactgctgggaccccagcaagacagggctgcaatttgctgtgcctgagcaagcaattggaaaggcccttcgtaaggggaggtgaggaggctgcactttagaagcaggcaaacctggggttcattcttggctctgttcattttatgttgctgaatgcaactctgcatgtgactgagcctcagtttctccatctgtagaaagggacagaaggatgtttcttgcctcatgttttctgaggatcagtgaaataaagtgtggaaatcgcagagtgtgggacctgcttcataccagcaagaaagttcaaagactcgtgtgacaatgttacgttctctgtaccatttatttttccttctgggcacacaagcttcctccattcagatggggccagaggagtgtgtgcagaagtgatatacactccttttgggccagacctattaaaaaactcccctatgcaagccccctctctttttcccctcctgctgtgacatttgagaccacatattaagtcaggcagcagctccagatcggagcctgggtccctgaatgactatgtggagtacagcaccacctctcctcatccagtaacttcactgggctgtgatgggaatgagaaaaagctgaaccaactgtgacttgtccaacccgtgagggcggggcaggtggtgctactgcagggaggctctgtctgttaccctggcccttctcgccttgatggcttagaaacctcattctggccatctatgcagtggacagatacccacagcatgcagacaatgccatagtttccagtcagcattttgtgggagctgaacagtgatcagaagcaggtttgctgcgtctggtctcatagtaggcggagttagctgattctgtctacccacagtgctattgggattcaattgtctgaaaggcgctccttctccctgagcacatctgcactcatctctgtggcttttcttctatgactcacctctgtgagctgaccgccaccttttattcttcaatgtttgtcccaagttagggtaatatagttaattaagtgaccaaccaactttttcagatatatttgcatgcatctgctgaattccaggctctgttgcctttatttcttgacttctgagataagcagagatgaaggaaactacagggtaccctcctcccaggtcttaacccatatctagcagttattgacccgtatctagtacgtctaggtattgcctgtgcctatggcccttacctttaccaccccaactccaggctaccacctttctcaccctctcttatccaaccatgaccataagactcttggttgactactagtccatgatgtcatcaaggaattgccctactgtcttcagaaatcacagaaaaggccaggtgtggtggctcatgcctgtaatcccagcactttgggaagccgagtcaggtggatcacctgaggtgaggagttcgagaccagcctggccaacatggtgaaaccctatctctactaaaaatacaagaaattagccgggtgtggtggtggttgcctgtaatcccaactactcgggatactgaggcaggagaatcttttgaacctaagagccagaggttgcagtgagccaagatcgcgccactgcactccagtctgggcgacaagagcaagactccatctcaaaaaaaagaacagaaaagacagctcatggatatacccatagtgattgcttttgcacaaaagggctcatgccaggcattcctggggctacatctgagaagagttcacccagtcccaaatttatcaaccatgatgccaacagaagttaccatgacctttgagattgcagtatcattagctctctcttacctttgtgcctattcctaggggtttcttctatggtcacttctgacatatctgtttaccattccttctgactttcatcctcaattccctctcactccttacaccttctgtcctctctaaaccttccaaatttggaactcagctccccttaatattctttatcctttctccagcatgcacatgcacatgcacactctctctctcaagttctttggggtataatagacttctgaggatttagggtactggaaggggtttatagcatagaaatacaaatgtcctcaatgggatctgatgaatttctgcccttacaagtgcccttgccatcccaggaagaagttcttggtggcagctctggtctcctaccatgttgccctggctcctcccctctctctccttcctcggaggctcttagagcagtctgacagcagacagttgcctcaggacctgtttgcacagctcatttctgccagccccacttgccagttcttcccccactggctctggattaattccctctggcagatgcatgacttttccctgcctttcttttgcatctcggaagcagggctccatttcactgccaggatggattttgccattgcctcagtccttgacacctacctgggctgggacatcactgcgtatagtcctgctcttgtcctgccaaaactgtgcggtcattgacatagttaagggcaggaggactcggcaggggctgcacagagcaggaggatggagatgaggagccattctcagcctggaccctggcagtggtaagtggcagccacccaactctaactggataaaaccccagaggaaggttgttggcccacgtccctggaatgctctggcatggagctgtctctgtgcagatcacatcctagggctcaaatgaggacccagggctttgtctcctttgtcattttctgttttgtttgttcctcattggcactattatcctacatgctgatgggataagttgggggccatttgggggctggcatctccagatccacaccttgtagtttaacaacctcaagggcaaaaggattatgtctccccatgtctgaaggccagtcccagggaaggattctgcctatccctgacagggttgagcgtccgattctagacccaccatctgcccagtggcagatggaaggacccagtctaagtcatgtgcccaattctttagccagagtgtgtgaacccaggccctccaggaggatgcaaagtgagacaagagcccttccactcaataggaatgctgggcataccaaaataggacatgcataggtggggctcccactggcatgcacctccccactttctgtaatagagcaggaagggagttggccgcatgaagtgttagggctgattggtaggttgtggtgtgtagtttgtgtctcctgctttcaggcttaaataacaatgagaatgatctattaataccttaaatttttgttgtaatgaatttcacactgatggaaacccattttagaactaaatatgttcagaactaagttgtgttatctatgtctatttcagagtctcagtccctctcagcttctctttctgcctgtccctgtgcttccctgacttcctgtctaacacttccccatctttctttctcctctcctcagtgtccgccagcctctgccccttccctctctcttgcaaccattcctatgcattcaaaaggtcacaaacaggtaacttggctcaccactgccatgcttgtcagtgtctgctgctactgatagtccctcctgaaaaacagttcctcttcctcctacctcttcctcctctcttccccctaccacgtcctcctctcttcccctgttctcccttccttctcattccctgtaaatcctgcttttttttgtctctccctttcatttcttattaatgccttgttacacaccaatgttttgggtgacacctgtcttgtccactgccatggagctgttggccatggcttctgcagactctcaggtgcaggggtcgagcctgcacaaatgtgtggcattaacattttcctttgagtattctttgattgaggacagcaagcaattagtaccatttgccattttgtttttgttgttgttgttgttttgagacagggtctcactctgtcgcctaggctgtggcacaatcatggctcactgcagcttcaacctcccaggctcagcgatcctcccacctcagcctctttgagtagctgggactacaggtgccaccacagccagctaatttttatattctttggagagacaaggtttcatcatgttgcccaggctagtctcaaactcctgagctcaagcaatgtgcccacctcatcttcccaaaatgctgggattacaggcgtgagccactgtgcccagccccatttgccactttgttaaattagtatagaaatatacacctggacagtgccatcttagtctccaaatgccccctattagttgactgattaatgtgacaaatatttattaaatacctgttatgccccagtaatcttctagacacagggatacagcaaacagccatatggatcagggcttcgactattttgaagcagatattctaatggaggggagaagaaaaatgagctcataagtgagaccatttagagagtggtaagaatgtcattctttttttttttctaagacagagtctcactctgttgcccaggctgaagtgcagtggtacaatcttggctcactgcaacctccacctcccaggttcaagcaattctacctcagcctcccgagtagctgggattacaggcacctgccaccatgcctggctaatttttgtatttttagtagagactcagtttctccatgttggccaggctagtctcaaactcctgcccttaagtgatccactcacctcggcctcccaagtgctaggattacaggcatgagctaccatgcccagccaagaatgtcattcttaattctgtgaatagtgaatgctttgtggacgggaactaactgcttgtttataattttacggctcaaaagcaagtcacaggatgacttgtattcagatcccagctctggcacttgccacatggacccggggcatgcacctacacttctgtaagcctgtcataccctctacaaagtgagcacagtgaggtggacccttcaggtttgttgtgaggtatgagtgagatgatgtggccagaacaggagtcagcagctccctacccctcgggctaacaccagctacttcctggccctgtcctgcaaggtggggctaagtatatctgaatgcaattattgggttacttcaacttgccacccctaaggctgttgacccatccaaatttaatctgtacaattgtgaggtataatttactattgtattagtttgccagggctgccataatgaactactatacactgggtggctttagacaacagtatattctcttacagttctggagtcctgaagtccaaggtccaagtgtcagtagggttggttccttctgatagctctgagggagaatctgtttcatgcctttttttttttttggaggcagaatcttgctctatcacacaggctggagtgcaatggtgtgatcttggctcactgcaacctccgtctcccgggttcaagccattctccctgcctcagcctcccgagtagctgggattacagactcccaccaccatgcccggctaatttttgcatttttagtagagacggggtttagccatgttgaccaggctggtcttggactcctgacgtcaggtgatccgcccaccttggcctcccaaaatgctgggattacaggcgtgagccaccatgcccagcccatgcctcttctaacttctgctggttgccagtgatctttgggtgttccttggcttataaatgcatcattcctgtctctgcctctgtcgtcacatggccttcttctctctgtgtgtttctgcatccaaatgttcctcattttagaaggatgccagtcattgatttggggcccaccttcttccagtaggacttcatcttggcttgattacatctacaaagaccctatttccaaataaggccacattctcaggtaccaggggctaggtgttgaacatatctttctggttgatacaattgaatccgcagcacccatgtgtattggctttcatgaatttgaaatccccctcccaactccttttgggttattcttgtatgtttttgcttctgaagaattcagacgcctccttttatgcccatacagaggtctgcaccttcccaggtgtgagaagtgaccacagattcacagcagacaagagtgtgatgaggtctggctgagaggctgggggctggtcctttccttccctccttccatctctcctcatcttttagtttcttcctttgtcttactgtcaggccagagcctgcccccttcccctgccaaggccctattgcccacagaagggcataaattgtaccccgtgtctctctccagccatagtctctctccagccatagttctcaggaaccccttccatgaaccccctttcttgaccacacaaattctaattccccaatgccatcacccttgttatccaaggtgacttcttgaaactacacatgtatagcaaacatgccaagttcattaggttatgggttccacgaggacaggcactgggtctgtgcttgctcggcctgtgtccctggtgcttggcacattgtgggccctcagtggacatttgttgcataaatgaagcaactgcagggcttggatacttctctattacttgctgcttctttgcaaaggtggacaaagcccttcacgatatcttttccttcagaccttttcactgcacacgaggctggagaccagcccagatagttctagttagcctcagagcctttgcacatgctgctcctttcctttggaatacctttccctacttcatcaaccattttataattcagcccatgtattttccctgcagggaagtcttacctgaaactttccccaccattgtaaactatattacatgcccccaaatcaacagcaggaacctctgctagactataattgttcgaaggtaagggctgtgtccaactatctgtttattctcagtatccctgtgtataggaggagctcagttggtggcactcccatgaaatcaaatagttctttgatgtgtacaaaatgatgaggatgcctcaaatatcccaaaattattatgattcttattttctaggtgaggaatcagagacttagagaggcttagtgacctctctacattaagacctaaggttaaggacagacaactagagtaaagttgagggccgagtggctgcaagttctcctggggttagcacagagtcaggcacacaacggagcaaatgctagggtatgggcgacccacagagaggcacgagaagccccagagcagggctggctcccagccatgtccttgggagactgtaggcatcaggagctgcagccactgccttccttgcgattcttgggagacttctgttctaattgctcttttcaagtgtcgtgcgtgcagttcaatgtgtgggggacatagtgtttgtagcaactgctaatgacagggctactgaaaaagactatttttggagttaagcttcagcctaaaagaaataaaaataaacactgagtttttttttttaaagaaaaatatgtagaaaggaatcaattccatctcaaaatgttctttctcctagtgagggtggagtaatctagaattagagtaaggcaatctgggtttaagtcatggttctgccatgaactcagttttccgtgggatgccttttcctccaattcctcctggtcctaaggacagctcaggggtcaagcctgacctggctgaagccgtttccctctcctctagtcacatttggctccatcacagttcttacagtcagtcttgaccttgaccaagcaatagaggttaagctttcccagggccattcccaagtagcaaccctccaaactgtgtctcatccaacccaaccttatctgagcttcaatgaatcatcagcaaagcctgttactaatagtgatagtaatacacatgttgataataactaacattttctgagagatgactatatcccaattccttattgagcacttctggaacactgtgtggtttttctgcaaagattcactcttcatgatccctccccatgggcagagtacacttcctgattggctttgacaaagccccattgaccttgagcttggccatgtggcttggtttgaaccgtagaatgtgggcagaagggatggtgtgccagttcccaggagagatttcaggaggtatcatgtgtccctgcttgctctgttgcctgctgccatccgtcactggaagaacctgcccctggcagcaacagctccttcagactagttcctggaatgagaggcatagggaatagattcaaacacagcctggagctaactgagaacaagaaacaagtatctgcgtacatcaagattcggggttgtttgtcactaagaaaaagctaagtaatacagtgctttaaagagatgatctaggtaattctcacagcagattttctgaggtaggtgtattattactccattttgtatgaggttgtgctaattcttttcccctgggatcctgccaagctctgcccttctataatgctaagtcttggtatctggcagcctcagctctccattaggttgtggtcagtgggccttgaagaacagcattgctttattggatttggataagaaggatgatgctattggagactctcagggctagagggactctctcttgggtccctgctggtgattggaagggctaagagtggtcctttatatgcctttattttacagagaggaactggcttctggaaggctacacctgcagggttggagtcaatgtcactccccagaacctactgtcccagaggtctatgaggatcccagtcccaggatcttgtggctcagctgtagtgatgacctcccagagggatggggccaaccaggccacatgtagaactcaaattctcctggtccctagtggccatatgcatgacagctacaagctggctcaggcattacaggaatcagtaagggaaaagcatctcagacacagcgtttcagggcccctaggtctgaattgggagacatggcttcagggtctgcttcccagttgagactcctgggcctttgcctgagctgaccataggacctcctcatgcaacacccattgccaccaaggccttttcctgcccacattgccagagcacctggccaaggccttcctccctactcccagtacatccctcgtgcctgcttctccccagatctggaccctgctgtgttatgagcccagaggaccaatgtgcaaaccatggaatgctgcttcctgtgaagtgaagatgtgtatgttgataaaccccaacagttcttcttagaagcctgtagcctccgatggctgcaagggcagtggatggagcaactgcaaaagcagcatattgattgcaaggaagtaactgaagggagagttcaaaatgcctcctggaaggcaggcagccctcggctctggcgaggtgctaatgagctccccagccagctccagttcgacctgccttttcccagcaaaagacccagggcctatgtcgagaagggcagcaggaagtgggggcgatggagatgattaatgtagagcagcttcatggttcataccagctctgctctctaagtcttttgtttcttcctccttttatcttcacaaggcaaagcaaagagcagcgcatgccgtgggaattccttcctgtaatgtgttctgatctgtttgcttgtataaatgagcccgtgtttcagaagagagtgaacccccctcgtctaaagggacataaacccaaggatttgctccatcctcccgctgtgatcttggccaccctcctggctttctaagactgagttaccttgtttccatgcagatgtcagaatgtacacgtcatctgcagggcaggtggttaaaccccatgtctagagagggagttgcttgaaagcaagcatgtgccagcgtattgaagtaagtgagggtggaagtaaagcacctttatttccacatgaggttgcatcattgtgtttccatgctgagaaggcctctcgagatatcagtgttcccatttattcatcctaaaactggtactttgtcttctatacaacctgtgtatgctaaagtatgtctgcaatacaaaaacaaggaagatgtaggccaggagataagtatccagggatcttttgtagtgtattaaaatatgaacatctgcattcccttttcaccttgaattttaaaaatcagtacatttttccttcttttcagagataatactttaccaccacgtttaagttctgggccctgaggcaaatatttcagctgttgagcccccaagcatcggactttcaatgaaaggaaacctgagttctaatcaactttgcagcaagaaacttgcaacaagaaacttgccaaacctctaagcatgaaacagcacgatctttcatcatttgatgcttttacctctgtggttttctttgttctatgcctgccccttcaccttcttctcgcagtcatccttcaaagctcatgttagatgtcatcctctctgtgaagacttctacagcttccccaagcagaaatgaacattccttcttggctctgccaaacatatctctatttaaaatatgcattgttcacttgttaattcatttactcacatatttattgcgtgagtagtatatacccaggcactatggataggtatccagagattcgattcaagggtcaatgaaactgatcaagcacatactatagaccagagctgcctaatagagctttctgctgtgattggaatgttctgtatctgtgctgtctggcatctctggctcagtagccacttatggctatcaaacacttgaaatgtggttatcatggctgaggaatggaattttaaattttatttatttttttttagaaaagtttaaatagccgcacatggacatagctggtggctaccatattgggcatcactattctacagggagagatggactttgaaagagttaatggaacaatatagaattacaaattgtgattgagactttgttgggatcaaatagagcatcacgacagaaagtaagtagggggctcccttcggtaagtggacaagagaagcttcttggaggaagagacatttggtttaaaacctggagaatgagaagatgtcagccatttaaagagtaggaagatgacctttatggggaaagggatcagtgagtgggaaactctagaggtaggaatgagtgtggcatgttgaaaggactgagggtggttgatgtggctgggatagatgggtgagtagtgggagtggaggctggataatcaggaatcaaatcacttaagaccttagaggccacaggggagggaaaggggcttgctggacatcccagcaccagtcaaagagcagagcacagggtgcatgtctcctagctgttagctccatagtttttctgctgtaccatgctgcccaagcaatgtggacgcacaaccttcacacagtgctgggcctggtggtgagcctcatctgcattctgtttccattcctgtctctagcctgacttatttaggcctgtctaatttatgtagcggctgtacatgggtagtgcatgtcaggctcgggggcctgcctgtgtttgtgaaagagaaatactaccatctccactggagccatcttttctgatcttgcctgctcggtaattaagattctggaagcatttagcacaaggaggaattgctgtaatgacaagtggatccttctgtaacctccacttaattggatgaagtgacagccccagcgaagactcaaataaaatttggtgcaattagactgcgctgaacgtctggtgccagaaccagggtggaaatcttgcagctggctcgtggaaccatagaggaatctggttgcacaaggggaggctgtgtttgcaggctaggtgaagatgttcttgcttcaccttttacctgcacccctcccttccattctgtaggtcttctctcaagattacttgaagggtggtggggggcacagaggtacagggagtatcttaggttgggttccctagaaacaaaatctgagacagagattgggtgcagaagatttatttgggaaagctgtatggacacccacctgtaaagaagtgggggaggctgggctgggcagagggagaagctgactcatgatgtagttacaaccgagggatcagtcaaccctgtgggagaacccaggagctgggatgctcctttagaattgcccccaaactgaggttagaggaccagacttttttattctcaaaccaatcagtcatcagccatgtcctctcacctccaagaaagcaaacatgatcttggctgagagagttcccagggaaggatgaagctgtgagcattcagcattgatagggtaggggtgcttccagcagcagaactacacagtgtttaccacaaagtgaaccagaactgacagcatttggttccctgagaatttctgatcttcctcagacattgactgcaaggtaaccacacaccctgaactgctctgttcctctcttccaattccctttgctctatcctctatctgttatgggtgaaaatgagaaagtctcttggctacctcgagtccaattttccctctattctttatccttcttgcttctaacactttcccaggcctccagtgcctctctcttattgctttctgcttttgtgtcccatggctgatcagctatgtctgaagtcagctattcaattcacttcctactcatgccatgattcttcccttttggtggtcttatttctagcagtgagtctggaagcccaacttctaccatctatcagagcaccctcctggagaaatatggaatgtgtgggctccaggtcagtcagaccagaataaggttctatgttctgccactttctagaagaatgacgttgggtagtaagtcaggttttctctttgtcaacattaaggacacagacatggattcatgtgtttggtgtcatactttcattttgagcctttctcatttgtaaaattagggcaaatctacctgcatcagagagcttttgggaggactaggaattgtatgctgggctcatagcacagtgcgtggcatatggcagaggttatcatccttgttggcttcattggaagctgtggtcaattcagcctggccaagggaagtccaggccaaatctcagcttagaacccagatgctggaatcctgagtgtagcacaaaatcttgagaagagaagaggtagccatggggaaatcaggttatctatgatttcatgggagagcctccagtcaagtccaagcccactccccaagagatctgaatggatggataccttgaagggtacatctgagtgcaatcctgtgtctcacagccagggaccaagctgcattcattcctggatcactcctttcctctgcctgtactgtcttcccagctttctcgttatatagccatggcctcacctttcacgtgggagaaggagattgtgagagtcatgtcaccccagtcccgtaactctggcttgttgtaggcatctttctgtccttgcatgcagcgagagctgacggaatcccacatctcagtcctgttcttcccctattgttggacacacagcaggactccacgggcaagtggaaaagaaaagccttgatcactgtttattttccttaattttcattgtgcttcttttatttttacccttgattacaagcaacagaaaatttcctctgtttttttctccccttttgcagctgtgggttttaatagcatccgctagaccgacccccctgggtagactcagaaaggagagaaattagctaaaagggaaacaagagaagcatttttagttcagggtgggagcctcattttgccaaacctgaggtcttttgcctggttccagagccttctttcagtgtcaacctacagcttctggagatgaagtgttttttgttgttgttattgttgttttgctcctttttttttaatttgaagacaaactcacctcctcgaagcccctctatggattgttctgtgagttgagtcacatcatttatagagagaaggtcaatctacttgtcaagtggctaagaatgtggttattttcctgttctttgttcactctttcagtcttacatattcattcattaaacatatgtaggtacctgctaattgcttgcattttgccagtggctaggatgtgaagttaaatgagatgatttcccctaacttcaaaggtgctcgtggcctggccagaaagacttggtgtgtaaaccaagaattgcaatgaagggtgagcaacgtcacatttagaaaatggtcattgttagcgcatgggcccgtggtcattgtcccttcgctcagttccgtgtgactttggctgcgataccttttctgcccctgtttcctcatcagctgtcgtgtaggaacaatggctttaccttagaagattctgaggattaaatgagatactgtatatgtgtgcttggtggaatgaactagaggtaactgctagtcaatgttggatgctcttagtgctgttgctgagtaaaggagccaggctgtggcttcagagactgggtttcaaaatctagcctcaccactggatcatttagcctatggcaagtccttacctctccccccttgcaagatgataatgtaattttgctcacaagtgaggcactgctactcaaagtgtgatcatggagcagcagcagcagtgatagaaacttatcagaaatgtaaattctccggccccaccccagacctattgaagcagaatctgagggtggggtttaggaatctgtctttaaagtccttcggggcattagaatgcctgggaaaaatttgagaggcactggcttagagataaggtatgacagttgtgtggcacagaatctgcccaaatactgatgcatggtaaaggtatttacagctgttagtgaagtgagagcaaacataatgggcaataattcttttcaagggtgctgcaagttgccctggaaggtcgtctggagccagctctagagagataattgtgggttttgagaaggaagagagcctctggatggaggcacaatgtgaggaaagatacagtggtatttggaggatggtgccaagtttggtgctgctcatgcacaaaattcaagaagaagggtggttggagatgcagcaagagagatacaatccagtagagccagatcaggagggtctgatttgaccaagctaagaacgttggacttgtacctggagaccattaaaaggttttaaacacaaaagtaacaaggtcaaatgtgtcattagtaagatcagtcattgaggctgcagtatggtagcaggaacacctagtagaccagggaaaataacagtccctggagtctccagaagaaaactttctactgaattgaacattggtgggcataccagttgtccttttcttacttgttcttccatttgctttcctgcaagcattcactggatacctgcaatgctctaggcactcacggacacacacacatacacataagtgacacctctgtaccctcccatggtccacagtctcctgagaaagatgtcagttattagacagtgtgataaaggagggcatccaaaccttatcgaacacctggcacactgtaagtgttatgttaatgaaatctctgctagctattgtatcttggcagtgttcttggtgtgttccaactgtgatcttatttggcctcacagtgacccattttacaactgaagaagcttcaccgaaagatgtcaagtaacaggtcttacataggattagatatctaagaggatatcaaatttgggacataccctctttttttgcttgcattggaacgggggggatggaggcccaaatgagaagagcagtcaggagacaggcacaaggccatctgaggttccccacaatggaggcctctctctgtcctgtcagcagcagggcagtcttcaaaagatgttaaaaagatgggcgtcgtgatcagagatactctggtacctcagagtattggcaggcaaaaagtgaggccttgggaggtaaccttttgtgaggggcactgacatttattcatagcatgtctgcttctttgcctaattctcttaagatctgtgtctgtgtcaaaatctcagcaggatgaatgaggtactgaagctcttctattctcccactgcctctccctgctcacacacaaaaatcccattagtaacagctcatcagtctccaaagtatagtgatagcatctgctgagggactgaacgtgagctgcacgtgtgtgtgcatctagagaatggaaggcaggaggaggacaagagagatggaagagcccgaggccctactgtgtggtgagttcttgacacaccagctcgtgtcttctcagcatggggaccagatagtgttcccattttgcaaatggtaaagtgaagcttacaaaggttatgtgtctcactcagggtcacaaagctgacagtaggctggaccagccccttttgccaaaggccatctggcctcagaatcctggttttgtttgtggctgcccgtaggcaacattgctgcaggtaacacctcagcaataggacctagtctttatgatgggcaagttaccatccactccatggccgtaggcccctgtagtagcagaataatggaccccttaaagatgcccacatccaggctgggtgtggtagctcacacctgtaatcccagcactttgggaggccaaggcaggcagatcacctgaggtcaggagtttaagaccagtctggccaacatggtgaaaccccatctctactaaaaatacaaaattagccaagtgtgctgatgtgtgcctgagatcccagctactcaggaggctgaggcacgaggattgcttgaacctgggacgcagaggttgcagtgagccaagatcatgccattacactccagcctgggcaaaaacagcaaaactcagtctataataataataataataataataataataataataataaagatgcccacattctactgtccagaatctatgaatgtattctctcacatagcagaagggattttgctggtatgatggagttaaggattttgaggtgggcaaattataccaatttatctgggcccaccgtaatcaaaaggggcataaaagagggagggagggatggtcagagtcagagtttgtgaacacacacgtgcatgtatctttgtaatagaatgatgtatattaatttgggtatatacccagtaatgggattgctgggtcaaatggtatttctggttctaaatctttgaggaattgcaacactgtctcccacaatggttgaactaatttacattcccaccaacagtgtaaaagtgtttctatttctgcgcaacctcgccagcatctgttgtttcttgactttttaaatcaccaagtttgtggaactttgctactgcagcaataggaaagtaataaaagtccctaggacttggaaggcaaatgtcacagtgagctgctttgcatgcacaaacaagactggatttgcataaccttggccacccttcccttctctgaacctcacttttctcatttgtaaagtggaggattttaatactattgtacaagtgtttgtctacctcatatacattcttccaatcccacctgagatgataaatctccctgcctagatgaaatgagcctgtcattaaacattctcaaggcacctgctctttcctttacagcatgtttgtttctagttagagtttattgaggaaggtttttttttctttctttttttgagacagtctcactctgtcacctaggagttcaagaccagcctggccaacatggtgaaaccccgtctctactaaaaatacaaaattagccgggcgtggtggtgtgtgcctgtgatccctgctactcaggaggctgaggcaggagaattgcttgaaccagggaggtggaggctacagtgagccgagatcattccattgaactccagcctgggcgaaaagagcaaaactcagtctcaaacacacacacacacacacacacacacacacacaaaagatgtccacatcctgctgtcaagaatctatgaatgtattctctcacatagcagaagggattttgctggtatgatggagttaaggattttgaggtgggcaaattatactgatttatctgggcccactgtaatcacaaggggtataaaagagggaggcagggatggtcagagtcaaaggaggagaggtggcaatggagagagagagaaagaagaagagattggaagatgctatgctaggctggagcgtaatggcaggatgatagctcactgcagccttgagctcctggcctcaagtgatcctcctgtcttggcctcccaaagtgttgggattacaagcatgagttaccatgtctaggcatgaagagattatttacagggatatgagcagaattgaggaaacaaatgaggaatgaggaggcagccagggacaaacaatagcagggagctgttacttcccaggtctcaaggggcaggggagggagtggtagaaactaagtatgaaaactaagaactttggggtaggggatggtggagggaaacaagaaagaaatgccctgagctttgtttttgttttaaatttaccttctacctcctgctgtagcctctcactggctgagccccactggccaccagagggtaagagggctgagagatgcagtgaatagatttgggcctccaggtgcatgagggaggacagagactgaattaggggagcaaacagaataattgaaacaaccacacagctggtgttgatgcattttcattgttatgtaatatttcttcataagattgatctcagtggttaatattacacttagctgattagattaaaaagtgagctttctgaaggcaaggattttattgctttgcctaccattgtctctccagggacagaacacacagtgggtgttcaatgaatatttgctgaatgaacaaatgattcaattcacacttgtgaaaatactttaaaagtcatgcattgctacatacaagcttattttcactcattgagacagcctcggagaggtaatatgaactcactaagatcaaacaggaagtatcaaagcaaggatttgagtcccagtcttctggatccaagcccagtgataatcccactccagtccagttgcctaccctgtccagataggagagcaaggattctgcctttggctttcaaatcacagccttctgatctgcccatcccatgtgggctccttgggtggctagctccccatgactgcttcctggggtagggtaccttctgcaaggaatgacaatgaggatatctcaaaagcacgtggcatcttgctgggatctcctctgaatttagaaacacacagttggctacattgggtagaaagggaggtgtgtcctgtccctgtagggtagagtggaagaggggtattatgcaggccctgaggatctgggaaggggagctacaagtccttttcaggcccctgaggatagaccacaggccacaactgcactgaacatggcaggtgcccgcattgctacatctggcccaccagccacttctggggatatggagatagtgagctctgtgggagctgccccacagcccagctcaccgggaaggccgccctgggaggcagtcactgcagcttcgaatgggacatccggcccctggttgacctgccagctgcttccgagctgggcaggaccatattcaagccctcgttttctgtgtgttcttggtgtggcccctttttctttaatattggcaaaatgaagatggtaagacaataatcccttctttgcaaaaccaggttggagacttaatcaaaatcgtgacaagacagcactgattgagcatttatatgttaggcattgacctaagcactctatatacatttacttatttaacactcccagaaagtcaatgagataagtactactcttacccctaggaagacattctgaggttatattcatattattaccaatgaagacaactgaagttgtgacttgttaaagtcactcattcagtatcagaagcaggatttgtactcaagtcatctgagtctggcaggcatgctttccatccactaatgtttaccaccttccaggataactgcagacttgttaaagtttgccatagtcctgaggaacatgtggtatgcgatgagctcatttctggggtgttgtgcacatagatctgtgctgtcctgtatgtcagctgttggccatgcgtggccttttaagttaattaagcttaagtaaaaataaaaatttcagtttcttggccacgtgagctgcatgtgcctagtggcaaccatgtgggatagtgtggatatagaatatctctggcattgtggagggttctgctggatgctgctgctgtagatgaagacattctcctacttttggacagagagcagacagagtgacccagagcactctgagactctcagaaaggacagagacggggagtcagctcccagcgagggtgcagaaagtggaatcgacaggcatttcttttgggaagtttctagccagcccatttacagtagaagcagatgtctcatggagcttccatccaatgtcagatcagagaagagactatttccaggagcaggagggtcagttgctaatgtccaggggatttagtcacatagaggccattagtgaattaagccagagatgttctggtaaggaggtgggcattggaggtgggtgtgaggcagtggagacagtgggcatgggtaaatcttgctggagaccagcaggattggcatcaccttggagtttgaaatgcagaattctggacaccccccaccccaccgactgaatcagaatctgtgttttaacaagttcatcaggtgactcatagacccgatatggtgagaagaatgtgcagagaggaagggaggacacttgggaggaagcaaagaggccagcaagcaggatttcccaatgcagctgagcacagtgctagatgctgcaaggaagggaaagggaacaggtgcagatacctctggcaacatgggggcattggcatccttccacaaagtggccccagcagagtatcaagacagacacaatttcatgagtccctgggggatgtggcagcagccaccaaaggatcagacatcactgggaggttatcactaaatggcattttactgatggtctgaaatgggttggcctgttgataagtggagggaggtgtctgtgcaattaggagatggaggtgagggatgcacctgtgtgtgcgtgcatggatgcacatggcagcagggatttccttggaaaaggccagaaacctgactatgaaactggctcatgataggaatgacaagggaaacttgctgctctgatgtcagccccaggatgctgcagagcctgcaggtcccacagtccattcacaccccaaactgcactgactgaccctcttcccctaacctgcttctttgtttgtgtccgtttctcagcatggctgtgtatccacttgtccaaccagaagcctgagggccagcccgactgctccctccccagcccttgtctgattggtcgcctgattacaacagcattacacatattcgctgcccacccaccacgcttccatccacccacaccgccaagacctgagtgacacccacatcctcccatcacatgaggcctccacaaccctgcctcctgtggatccatctcatctccagttcaccatcatgcacttcccttgacatccccttgttccttgtctttcaggggctccctgctgcctttaagatacattttaacttttgagtctgacttcaagtacccttcatctcctcatttccaggcatcctgtccctgggtttgccttctttcaggcccaagtaacttttgttcatgaagttacccttgaacatgcaaactccctgctttttgttcatgctgcttgaaccgtggtctgacctccttggaggagtgctgtctgtgtagagctaacacttcgttctgtcccacattcctcttgtttgacacttgttacactttgtcagttgtgtgtttgtcttttcacattgacaggctgtgagctcagagcatctgggacagtgtgcaggcagacagggtaagcacagggctgcatgccaggaggtctctcgagcttcctaagctcatcaaggttactggaccccaactctctagtgagagacagttatattcaaaaatgcctgcgacacattattctatgcctctatgacaagcaattctgacaaaatatcttgaaaacagctgctaagtatgtgatctggggatttgacagtgcagaaggacaattctgcatactcaggaaagcttggagaaaatccagtataacttcagtcatgataatgaattgtacttattcaagaaggagccacattttgataatggggaggcaagcacgacttatagacaacttctctctatacaaggagtgagctgtggacacatatattctggtgacaatggaacattcgtcagttttttcttgcctttgaccctttttctttaactcttatttcggaatctaacttatacgtcagtttcttcattgacccctccataattcccacctctgcaacacacatctcaccttacttccttgcaatcacttgcttatatgcattctcttattgcactaccagtcagacacaaccatgtgaccttgggctaatcagttaaattttcatgcctcagtattcacatatgtaaaatgggaatagtgatttttacctcccattctgctaagggatacacatgatatcatttatcatgcatgtaagcccacggttcggtacaaaggcaatgttcaatatatattcactgcacttttcttccttgttcagcatcccagtggaactgttatctcctcaagggtatgaaggatttcttttttccctgtaaatcacccagtaggcatttagtatgtgtcaaaggtgagtggctaaatgatgagtaagtgagttaaatgaaacttgttatttcttacaatatctctagtatctgcaccgattgtcccacacctaggggtcttgcccaaatgcatgtgagttcatggtggaggcctttggtaggaatgacccctttcgttgcttcatctaccacttctttgtcagatgtgtctttctccacatccgttcttaccctgtgtcagagtggcaggtgtttccatctacctggggacgtggggctgccctttctgcttcttctctgggtatccagtgacgtttatacactggctcttctgtttggtctctaaacatatccctatctctctcatcctgagaaagaacaccctgcttgatttgctcatagtttctataggtcaccatgaccatagacctttcactatttgctaaacacttcatatgcattgtcttatttacttctcacaatagcctttaacaatactctttagctgtaacattcccacattggagctgaaaaaaatgaggctcagaggggagaaataacttgcccaaggaccacggctatagagctaacttcttgccttcctgccaagctgttggagagaagtcactttattggccacagtttttcaggactttccctcaggactgggcttccataactatatctcttggtttcttaacaatttctacagctgaaccttttctgtcttggtcacagctttctgtttctgggcctttcccttaaatataatgttccccagagtgctggctaccataccccttcatatttctctttgtgagtgagtctatccaatctcattattttaattatgaccagggaggctgatgactcccacacccatatctcttgcgcggacagttctgctgaacttacgattaactagctgttggagttattcctgtggattgccacaggcacttcaactcaacatgttcttctcgaagttttcatctccatcattggctcaaccattcatttcttcagcgaagctaaaaagaaacctaagattcatttcagattcctgccttttcctcagtcctcgccctactccatccctgcatatgttcaattaaaacagacccaccaacttagctcctgaatatttcttgactatgtatctttcctaccatcactagtatcactgcattggctctcgtcagctctcaactggactcttgcagttccttattttttggtgtgtgtgtggataaacctttattttgaagaataataaaaatgcaggaaaagacacattataactgaatataataatgtaaacaacatcctgatcgagatacagaatataaccagcacctcagaagccctcctcggtctcactccaagtcattgattctcctttgcaaaggtattgtgactactagaattattttccctgtttttgaattttatataaataagagcataaattatatattttttggctagtttcttccacttgaaattatatttgagtctcatccatgttgtattcactttttaatttatttttaatttattttttttaaggcagagtcttgctctgtctcccaggctggagtgcagtggcgcaatctcggcccactgcaagctccgccccctgggttcacgccattcccctgcctcagcctcccgagtagctggaactactggcgcccgccaccaagcccggctgattttttgtatttttagtggagatggggtttcaccgtgttagccagtatggtcttgatcccctgacctcgtgatccacccgcctcggcctcccaaagtgctgggattacaggcgtgagccaccgtgcctggcccacgttgttactcttaaatagtatgtcatggaatgaatataccaaaatgtatccattctactgcttacagacatctgagttgtttctattatttagacataatgaaccacgtgactgtaaatattctgtacgtgtttttggtagtattggactccatttctcttggatatgtaactaggagtagagttgttctttggcttaagcagatactgccaaatagctttctaatatgacagattgcatattggtgttgtctgtgttttaatattagccattctggtaggtatgtggtgatagctcattgtggtatttttctgatgactagtgaaattgagcaacctttacatatgcgcgtgtgcacgcgcatgcacacacacacacacacacaggtgatcttgatgtcatgtgtttgaattggatattcaggtcttttgtttttttatattgagttgtgtcttattgatttgtagttctttatatttactagatctgagtccttgtatacatatcataaatatcctttttctttctgtagcttgccttttcacttaattaatggcatctgttgatgaataacagttttgattttaaagatgtcccattatcagtcttttatttatttttgccatatttaagaaatacttgtgttccccacaataaaaaaaaaatcctgtctcacattatctttagaatttctattactctacatttcaaatataggtctatgtaatccatctaaaattgattttcacataaagtgttatatagatactataaaaactgtcactttgattctgtctgtatggatatcagttgacccaggactcttgttaaaaatatcatctttccccagctgatttcagttgaacctttataatatatcaggtgtctgcatatgtaagggtttattttggatcttctgctgttgttcttttttttctgtagatctattttttatcattattttgatgtcttgttgtcttaattgttatagctttatgacaagtcttgaaatccatgtaagacctacacctctgcttttattattattattattattattattatactttaagttttagggtacatgtgcacaacgtgcaggttagttacatatgtatacatgtgccatgttggtgtgctgtacccattaactcatcatttaacattaggtatatctcctaatgctatccctcccgcctccccccaccccacaacaggccctggtgtgtgatgttccccttcctgtgtccatgtgttcttattgttcaattcccacctatgagtgagaacatgcggtgtttggttttttgtccttatgatagtttgctgagaatgatggtttcctgcttcatccatgtccctacaaaggacatgaactcatcattttttatggctgcatagtattccatggtgtatatgtgctacattttcttaatccagtccatcattgttggacatttgggttggttccaagtctttgctattgtgagtagtgccacaataaacatacatgtgcgtgtgtctttatagcagcatgatttataatcctttgggaatgggagaaaatttttgcaatgtactcatctgacaaagggctaatatccagaatctacaacgaactcaaacaaatttacaagaaaaaaacaaacaaccccatcaaaaagtgggtgaaggatatgaacaggcacttctcaaaagaagacatttatgcaaccaaaagacacatgaaaaaatgctcatcatcactggtcatcagagaaatgaaaatcaaagccacaatgagataccatctcacaccagttggaatggcgatcattaaaaagtcaggaaacaacaggtgctggagaggatgtggagaaataggaacacttttatactgttggtgggactgtaaactagttcaaccatgtggaagacagtatggcaattcctcagagatctagaactagaaataccatttgacccagccatcccattactgggtatataccctctgcaatttttttttaaatagcaattatttttttgctcacatgtctgtggtttagttaggagtcagctgatccgagctatttagcagagcatctctattcaagctgtgggtctggccagctcagatctatgctcttttttcattctgagacccagaaccgtgggagcagccaccaagagtggaagattcttacaacagaagtgcaatagagcaagtcccactgcacaagtactttttaaacaatgtattttattttttagagcagtgttaggttcacagcaaatgtgagtaaaaagtataaagttcccatatatctctggatttgcacatggactcttttaatcaagattgttttaactatttttggttctttatacttccatacaagctttagcaccaatatgttgatttatttaaaaagaaaaaatacttttgggattttgatcaaaatttacgctaagtctgtagagcaattttgggagaatctaccacttaattggaaccttccaatccatgaatatggtatctctcttggttccttatgtttttttaaaattctcagaaatgtgttaaagatatttttctacactgtcacgggttgcaaagtctctttattttttaatatttgtgtatatgtatccattgttcagactggattagttctgttgatctgcttttatattcaaggactctttcttctgcagtgcctgcactgctactaaccccagagtaagctttttattttagatatggtagtttttagtcatcagatttttatttttattttcttacttctgatgtctctgctgtgatttcctagctatcctcccattatatccaattttctttaaatctttcaaaaatatttatagtatctattttaaagttctcatctgcaaattctaacatctgaattatcttgggatctgttcattttactccttatttgtttgcctatctaattacttatttatgtcctgtttgttacctaagaatggtagatagtttgctgtaggtggtctggattatattgattggacttaaatggtattgaattttatcctggtaagcagttaaattaccggcgtgtccttctgaaactgtcattattgtcttatactttgttaggagggatctattttggcttatcagttatcttcatgtgtgtgccttactttgattttgatgtaatattcactactataacctgctctttctgaagcctcaactgcaactccactgcaggtgggccaggattccagaggttcccagcactggtcaacctctcacatttctgttcagctctcagccctgcatcaaccactcttttctagaccttacagagttttaccttgcaaatatgcaggccagccaatatccaaattctaacaggtactccccatatgaactctctggtacccttcctcacaaattccagatgagtcagcagcccagaactctaattcgggttcctcagttcaacaagactgcgatgctgtttggcctccacctctctgtgtcgggtctagaaaataaccaccaggcagaaagccaagacaaacatgagtctcacttctgtatttcttcgctatcaatgatcaaaatactgtgctggaaaaaatcactcatatatttttgtagtgttttgattgttttggcaggataccaagttaagtgccagttagtcagttgtggccagatgtggacgtgtttgtcatgagatgctggagactgaaatcacctttttgtctgctacatagtgtactttatactatgatctctgtccaggcagaattgtatcctgtttatagttgtatttctggcttctaatactgcacctgtcacagaatttgtacataaataataagtgagtgtgtgttgatttgactcatagtttggcccccatctggacactcattggttcatttaggatgttgccagatgacagtaaagtgagaaaatgctcatcaggcagctggtccaaagtttcctccaaaatgtggtcttgccttttctctattccacatgattcttagaaccccagaaacataaagctggaaggaagtagacctgagacctcagctatcccatagctctttttgaaccagtggggaaactgaggctctgagagggcaaggtgctcacccaacagctgcatgggaaatgagagccctacctagagcttggttctgcttacttctttccgtgttgtcttagtccattcttgcgttgctataaagaaatacctgagactggataatttataaagaaagagatttaattggctcatggttctgcaggttatacaggaaacgtaatgctatcacctgctaggcttctggggaggtctcaggaaacttatagtcatggcagaaggcaaaggggaagcaggcatgtcacatggcccgaactggaggaagagagagggggaggtgctatgcacttttaaatgaccagcttttaagagaactcactcactatagtaaggacagtaccaagagggatggtgctaaactatttgtgagaaatccgctcccatgatccagtcacctcccactacatcccacctccaacaatcggggttacattttagtgcagtctggcagggacacacatccaaactgtatcacatgtcttccttcacttatccctaagttcatttttttcaaaattgaaaagaaaatgttaaaagtcttacagtttcatttaaggtatatggtgaaatttctgaagagcaatggatgataggaaggcagataatacaatgtatactgggaatagagaagagaaaaattttgcccatgagaaacctttgggtagtgggctccaggaggaagatacttgagattcgtcagcatcttcagaatgtgcttttgggaattttcttgattcttattcaacccctggctggcagcagttaaaaatattgcaatgttactcatttttttgtggtaatatatttatgtggttcaaaaaatcaaaagaaagaaaaaggtacactgaaaattactctttttattccttatcctagccacacatttctcttccctggagattaccaatgttactctgtgtgtgtgtgtgtgtgtgtgtgtgtatgtgtgcgtgtacgtgtgtatgtgtatgtatatctttccaaaggtatttcatgtgtagattaatcaaaattaaatccccatcatattatcttctttttcttacataaattgtagcgtatttcaaaaactcttttggctttatttttttccacttaatgtatcttggatgtatttctgcattcagacataaagagcttcctcctttctcatagctctgggatattccattgtatgcacgcaccatcatttatttacttgggttctataggtgggcatttggattgctttcagttttttcctgttacaaacaatattgcaatgaattactttgagcaaacattatttcactgtgcaagcatatctttagcataattcctaggtctgagattgctaaacatttttaactttgatagatatggccaaattattctccataggggatgtaccaatttataggcctatcagctatgtgtgagagttgacatcagtttttattattatattttaagctggaaatcaccttacatatcacttttccatttctcttgtgctatgaatagggagtccagggctcagagatagaaccaaggtcacgctgatagtctgtttttgaggtggtcgtgaatctgggtatcctaactgtttagcctgagtgatcttgcataacctcagggtgcacagatgtgtactgtccctggcaaacatgtcatctcactgagtatcatcaactgggaggagtacatagaacctgtctcttagtacccaaagttctcagtaggggcttcttttttgggctgctacataatgtttgcttctcttaaaatcagggctaacatacccactgccaagccagttgtggcctgagaaaatctaagctgacatccaggcagggcagaacccacaattagatcctgtgggacttggggaaagggactatcttggcacctggacctcttcgggagcctgttgagagaagaacaatgtcattcaggattattttcctaatgagatacctcttgctgtcagaatgccctcatgcttggcatctcctgcatcacctttgtctcattagtccaggtaatgaatggcacagtatactgctcattttaaagtgggattcttgtgacatccctgcttccacttgaacacaatgttgggttatccaggcatcaaggggcagagggaagtttccacagtgaatgagagtcatgggctgtggagtcaggccacctgaacttgagtcttggttctatcagtggtagccatgtgcttttgagccaatgatttcatctgtcagcctcattttctccacttgttagagggggagagtagcttaaagctatactagataggatgcaggaggtaatgctgcagtaacaaacagccccataagtccgaggctagaaaaaaaaaagttcaatttgttcatattccttggcatttggatagggctctactctatacatgggatccaagatgtgctagttcattttgaatcactataaagaaatacctgagaatgaaaaatttataaagaaaagaggtttatttggctctgcatggttgtgtaagctgtatatgaagcatagtgccagcatttgcttctggtgagggcctcaggaggcttccaatcatggtggaaggcaaagggaaaccattatgtcacatggcaagagatggagcaagagagaggtggaggtgctgggctcttttaaacaaccagatctcatgtgaatggattaccacagggagagccttaagacattcatgagggatctgccccccatgacccaaacacctcccaccaggtcccacctcccacactggggattacttttcaacaagagatttgtagagggggcaaacattcaaactatatcattccacccctggaccccaaatatcatgtccttctcacatgcaaaacacattcatttcttcccagtagttccccaaagtcttaacttattagagcatccactcagaagtcaaaagttcatagtcttatctgagactcaaaacaagttccttccatccatgagcctacaataccaaaaacaagttatttatttcaaagatgcaatagtagtacaggattaggtaaacactgccattccagaagggagaaattggcccgaagaaaagggcaacaggccccatgcaagtctggaacccagcagggcaggcattaaatcttaaagctctaaaacaacctcctttgactctatgtcccatatctaaggcacattggtgcaaggggtgggctcccaaggccttgggcattcctgtccctgtggctttcttggacacagcccatgtggctgctctcatgggttggagttgagtaccttctgttttttcaggctcagagtacaagctgctggtggctctaccattctgggatctggagggcagtggccctcattcccacaattccactgtgcagtaccctggtggggaatctttgtgggggctccagccccacatttctccatggcactgctctagtagagtctctttgcagggctctgcccttgtggcaggccagagtgcaagagtgaaggatgcttaccagcttccacctagatttcagaggatgtatcagaaagcctgcattctgtgcacttgcaaacataacaccatgtggaagcttccaaggcttatggattgtgccctctgggctggcaacctgagctgtatctggggccctttgagccacagtgggagctggagcagccaggatatagggagcagtgtcctgaggctgggcagggcagaagggtcccatgcctggcccctaaaaccattctttcctcctatgcctctgggcctgtgatgggaggggctgtactgaggatctctgaaatggatttaaggcctttcccccattgtcttggctattagcccttgtctcccttttagtcatgctaatctctctagcaaatggtttctctatagcccacttgaattcctcttctgaaaaagttctttctttctctcccatatggccaggctgcagattttccaatgttatactttctgcttttcttttaattataagttctgaacttggtcactcctttgttcccacatctgatcataggctattagaagcagccaggccatatcttgaacactttgctgcttagaaatttattctgccagttaccctaagtcatcactcttaagttcaaccttccacagattcttagggcatgagcataatgcagccaagttttttgctagggtgtaacatgagtgacctttattctagtccctaataaatccttcatttccatctaagacctcatcagcctggccttcactgtccgtatttctatcagcattttggtcacaaccacttaacaagtctctaagacgttccaaactttccctcatctccctctctttttctgaaatctccaaactcttccagcctctgcccattaccagttcaaaaaccagttcaacatcttcaggtacttttatagcaacactccattcctggtaccaattttctgtgttagtccattttacattgctataaaggaatatctgaggttgggtaatttataaagaaaaaaggtctatttggctaatggttctacaggctgtacacaaagcatactggtagcatctatttctagcaagggccccaggaagcttccaataatggtggaaggcaaaagggagcctgcttgtcacatggcaagaaagggagcaagggagagagaagaaaagtcctaggctcttttaaataaccagatctatgtgaacttattactgcaaggaggccatcaagccattcgtgatggatccacccctatgaccgaaacaccttccaccaggtcccacctccaacactggagattacatttcaacatgagattctgtggaggggacaaacatccgtaacacactgcaagatgatagagcagccgccatctgtaactttgctggtgactatgacaaagaggaaaagaggatgtggggaactgagcactggccctttctgtcccgaaggaccttaggtcctttgtactcacattttaataaccaaagcaagctacaagcttggcatgcctctgagtttacattacaccatgtagtatttggattttcagttctctgaggcagaaacctctctgtacacctccacctggcagcctccatttgcagcacttgctgcccattctctctgctatggatgggatttggtgtcctctctctggcttgacctttaacagtgtaattctgctcgttaatgccaatgctagcaacattcctatggaggtaggcatgggtagtcatcacccatttcaggtgttgtaaaactgaaactgctagagactgtattccctaagatcacacagcaaatatatggaaaaagagggaagtacaatttattaagtaatacattcataatgtctttattatgatagggcactgaggccacagaatgttaagcaacttgttcaagccactcaggaggtagctatggaaagagaaagaccaagacagagacctacgggaaatgcaaagtggaacgtgtagagcatgcctgctatcttgggcccttaacacaagctgcaattttagccccaagtatacggtgtctatgtttctttctcttgggcagggaggagaatggccacaaggagggcctgtgtggaatttctagagaaatgagtcattgtgatgtggtgatatattaatctaactgagaaatctctctctccagtggaattttataggatgtcagttctcatgtggttctctttttcaagtagcttggctcataggacaccatgcttcctattagagtctatcctgtctgttcaatgtgggctgggggcaagaaaaatcttgaattttataatattttatattcttaaaatgataaaagaagactaatgacaactttgaactaataatcctgtcaccctagtacatccaaagtctctttgattttttgttttatccacataaatatgtatttggcatagataccatcagaagagagtaccattttatttcagttattttaaagttaatgctatattacacatattttgcatatttctttatgacctttagcatttttataatttaataattgcatacaattttaaggagtgaatgtacctacctgtattggttttctatttttgcataagaaattaccacaaacttggcagcttaaaataatttatgatctcagagttctgtaggttagaaacctgggcatagcatggttggaatctcttcaatataacacaaagctggagtcaaggtgttagctgagctgaattttcatctggagacactggataaaaatctgcttcaagctcattgtgttttgattttcgagatggggtattgctgtgttgctcaggctggtctgaaactcctgagctcagctgatcctcttgcctcagcctcccccagtagctgagactaaaggcatacatcaccatgcctagctctaggctcatccttgttgctggttgaattctgatccttgtgatggtgggactgaaggccccatttctttgctggctattagccggtggccactctcagctcctagaggccacacacattctttgtcatgtgcttccttcatcttcaaagccaaaaatggagcctgtctctcaaataaaaatgttctgacaccacacatctctttcgccagaaggaatttccatcttttttaagagttcaccttactatgtcagatctactcagaataatctccctttcttagagtcaagggtgccatgtaacataacctactcatgggaatgctatctcggcatatgcatgctcccaaggattatacagggcccgtataacaggatgaaaatgttaagagccaacagaattctaccaactcattatcttttcttaccattctattaatttcctagggctgctacaacaaagcaccacaaactgtgtgtggcaaaaaaaacaacaaacaaaaaaacaacacacagaaatttattcactcacagttctggaggctaagagtctgacagcaaggtgttagcagggccagactccttttggaatctgaagggtaattcttccttgcctcttcctggcttttggaggttgcctggcaatctttggcatcctcgtcttgtagattcattactccagtcctctgtcttcacactgcattctccctgtttccctgtctgtgcatcttctcctataaagacaccagccaaattggattaaggccaaccctattccagtatagtgtttcatcttgaacagattacatctgcaacaaccctatttccaaataaggtaacattctgaggtactgagggttaggacttcaacatattcttttgggtggacacaattatatgacaatatgctgtaattgtatttttaggtatttcaagattctgtatggcacataattttgtaataatcattgttgattctgtaatagtttcagttatttctttatctagggagtccctagaatgagatctttgcacataacaattctttctaatgaagaaagaagaaactaaatttttaaaatgactgctatgtgccaggtgctgagatgcctatgtgcccatatgttttactttctatgctcaatacaaaatgttgagatattagcaacttttcacaggataaaaatactttaatgcagcaagtaacttgctcaaatgtacgtacctagtacatccactaatcaaggcccagcaaaaaaaaatacaaactccagatgtttcaaacagaaggaatttaatgtagggaattggttgcaaagatgagccaattcagagattaacaacaaacagaagctatggtgggaagtccagcattggcctgagatgctacaagaacatctgcctaaagaagagagggttagtggggagagagacagatagacacacacacacatacacacacacacacacacacacacacagagagagagagagagataaagagagacaaagagagacagacagacacagacagacagacatacatgacctggagtctccctcctcctaatctcctaagagtgcatctagctgatcaaatcagaagccagctgaggagcttgggaaacctgttccccaccccctaatctccactccaacctctccccattatacagagcagaacagatcaagggcaaggaatctatctaatggtgaacaggcctaggaccatcctagtccataatagtaagagtaatgttcataacataatcatatcaatagctaacatgtactaaatgcttattattatgtgacagacaactacagttattccctgatttcatcccagccttgagtcccccatgtgtctaagcatcttggaagagtagacataacagaaatgagaagccacaatagaagccaaggttgccatgaggactgcattaaatgagacaaggtaatgaggaagtgctttgcaagtctgagagcattgtgcaggtgacaagtgacatgattacaacagaccaaagctgcactttcacaggagtcttgatttgcacattatcattattattattgtaaggtcctctgagctagccacaccatggtcaagccatcgtgacattccctgtccttgtgataatgtactttgtgatattccctttccttgtgaatgtactttgtaacattcctccccaccctagtgacaatacacccccgcacctccccccaccccgcccttgtgaatgctgcctgcaaaaattgctcctaactccaccacctatcccaaacctataagaaccaacgataatcccaccacccttcgctgactcctttctcggactcagcccacttgcacccaagtgaataaacagccttgttgctcactctaagcctgctcaagtagccttttatatggacgtgtgtaacaattattattattattatttcgagatacaatttcactctttttgcccatgctggggtgcagtagtgcaatcttggctcagggcaacctctgcctcccgggttaaagtgattctcctgcctcagcctcctgagtagctgggattacaggcatgcaccaccatgcccagctgattttgtatttttagtagagatggggtttctccatgttggtcaggctggtctcgaacttccgacctcaggtgatctgcctgcctcaatctcccaaagtgctgggattacaggtatgagccaccacgcccggccgcatgttattatttttgatgctcatttggaatatgatttgaagtatgacaacaatcgaataggaaaggtattcatttcagtgtaggaagaaagtaaacagccaatacctggagcctctattctgtatcagcccctacatgaccctttccttcagagagctttgcagtctggggttatgcataattacagttcggtgtgatgggtgcataacagtgtgtgtgcagcatagggaagtagcagagaggcatgagggtttgttttgtctacctggggtcagagaaggcttcccaaattagttctgtcagaggatcagagaagaggggttttccagttaacaggatctgaatgtggaaggtagaaaggcccagaatggtatttagtttgccatggcacaagatggcatgcatgacatggaggtggactcaataggaaagcttgattatggaaagaattctgtatcaggaaaggaagtggaactttttttttttttttggatatcaacgccttccagctaaagaccattaggaacacacccatagttgaacaagttgggtttatgacttattgtagtgagggagaatgtacaccacagagaaccatggggtgtctcggcaagacagtgttaagggatttgggctttggatggatgattttgggagacatcaagggggtggagttttttctagattgagctgttaggaagtggggacaattctatgattgaatatctgaggaaacctaatctagaaggggataatagtagagcaagattaaagctataattggtagagttgcggcagccactcatttgagctggacaagaaagatacatggtattttgcgatttgcacagtgaccttggttttgtcttgcttagaaaaaaaaatatgaagtcatcttgttccttatcacttcactgtggctacagaatgacctgacctgatcttggtgttgtgtaagattgtttaggtccaataggggaacaaaatggcctgggtgagaaagttgggccagcttccaacaacatcaagttttagctgataggaccaaaccccggatgacaggagctgcttttctatttcttagagcacagtaggaagccgcagagagctcgtgtgcaggggcaagtagaggtggcatctggttttacaaagctctctaaggcacacgtgatgtttctataagtgactgttccttggattcttgtatggccttggataagttccttccctctttgagataagcttttctgtgtagtaaatggaaggagtgaggctagatggtctctaagcttcgtcttccaagagctgaggtttaataaataaaacctgggttgcagtaaaaggagcagaaagaggagcatcagttggatcatgagaactctatgttgctgggcccactgcacatagctctgcctaccatagccaagaccacttttaggttggggttcaacttccattcaccccactcctggtaacaatgctctttctttacttttctcttatttccttttctgtctcttttttcttttctttcctcctttcttttctactatctttgtttttgttactcaacagaggaattttttttatggaaatagtcaatgaataggttttactggcttccagtgtgagctaattaaaggttcaaacagcacttccatagaattctggtgtgtctgtctctgtctctctctctctctctgtgtctctctttccctttctccacattcttattctctggccccacatggtcagatgaagtctgcagcagtactaatcccagcattctcccttatggatgaataaactatttatgattgcagttgggcagaattgggtcgtgtgtccatccctaaactatgggagtgggaaagtagatatgctgattgacttaagctaatctgaacctactctgatcataccctgctgctggcaggataaatcccaaaccatatgggctggctatgggataggggtctttaagagaaatttgcgaaggtgcttaaccagaagaattgtgaattgaatttgagaggcaaaaacaaaactaagagatgttctcctcagggatgctcagggaagtataaactgtgttaggtagagcctttgaatcaagaagatctggttctagctctgccactgactttctaagggaacttgataaacaccaccttgctacctcttggcctctgtttcccactgtaggttaatggtgatagaacagtgttctcaaagttctgtagggctgtggatctttacaatactttccatgggcctgcattcattacaggacacagggcagccctcccaggggtgctggacggccactgtttatggagatgcactgaagtagattgttaagagttttgctccctttgctagggggaaaaggatccatgggggttcagtgtgtcaagggagctttgtcagatgcagtacagagaatgcattcaggactggaaacattcaaatgacttttcaccccagccttttaaagcctctgcagcaaggttgtggtttgccttccttgcaaccttgggctctctgcttcctctttattatccgtgttgatccctggagatgttaatgagcattgcacattgagaagatgaggagaataccttctgggcccaacaacatggagacaccccaaacagctcaaagaatagctgtcagaataggcccatcatgatacaagcaccaatagtggaggacaaagaacactctgttcaaagttcagcaacactcccacaggaggtgggaggatactcatgagggtggaacaggatgtgattggtgggtgcagactgtgattagcagctgtgggaaatttgaggttaagcaagtgtgacaagtgggaagtgggtaaacagagagggaggggctgggattagagtcgggttagggtaagggttaacctcggtgacgcggggctgcacacactcttacctgttttgccacttgatacctctatggccttgcgtatatctctctgaatctcagtgctcgtatctgtaaaatgggcagaaacaagaactctagatctagctgttccacagtacctttggggactcaaatacctccaaggtatggagcactgtagcaggctacttagtgtgaggactatgaaaacgatgacagcagagctcgtgatccaagtgtcttcttggtgggacccttctaaatctttccctgggacaccacattctccaattgcggacatccagtctctataggattgcccacatcttgctctgccttggaatttgtgcacaccatttcaagtcctgagttcaccctggccatgcctgggagagactatgggatttgcaattctcaatgtaaaccccaggtccacttgtccctttttggggaatttcttctctccgctggctttcttttctgagctctgtgaggttgagcatatgctaaagagtcaatgaagagaagagtctctgagcctgaaatttgaaaagggggccctctaattacattgcaccatgacattttctcagtaacatcatttaagcatcccacggtagcacctatcattactgactaatctactgttgtgtgggttactaatgcctactgttacatcagtgaccttccctgcctttctctgattctggtttggataacttaccttgcagttccaggattttctccagaatgagcaggaatgactcacattactgccctaaaatcccgtggaaatgtatccccactctcttccttcccagtgtgataaatttgattataacttacggatggccactcatgactctgcggtggtttaaaatacaccgaaagattcattcgactaaactgagttgtcaggtggagagccagagggaattcttgttgcagacacaagttgtgttatgtctgctgtatgtagccttgtggcggctttcaaattgctgttgggaaataaatccattaatcagtgtggaccgcccccactggctctgcctggctataggctcctaggaggcagaatgtccatcttactccctcacctgtcttagtgtgtctgataatatgcccttgataattgatttttattttactttaacattacgctcctaaaaaataagatctccagttatagtaggtggaaatggcctcagagacctccttgtccagcccctagatgagggttctgagagccagagagggatggtgacttatcccaggccacacagaaagtcatcaaaaagctggaccaggccctggtttctgactcccagcccagggctctgacatccttttgtgcttttcttggctgctcctgttaacgagggatgcgaggaattctatttgggctttattctactgttttacagtctcttctgagtaataaggtcggcttgtttaataagttcagcttcaaagtaggtcagggattttatttctgtgcatgggccattagcattcttaagtgagaacacatttttttaaactgagaaaatatccgcggtgtagtcgaggcgctctgcgtctgtttcctaagccatgtcagatccttttataccacacagcttgtgtgaggggggcctgccagcctccaggcttcttgatgggggctgaggctcagtgggagggacaggagaggactgcctgctgtggagagaccccaggagctgcatcacacagagctcaggcgagaagggcaaggtgacttccgtgggcttctcaagctggtggtcacatcgaaatgaggtttgtgtttcgttttgtcagagataattttctgaaaaatccccaaacgctaggttagagatggtcgagtgctatgtcaagaaatctttcaaatctcttgtgacttaagtgctttcctggattcactgcccagtggccaagctggtagagaagaaatcaggggtcagggtctcactgctgttgtcagggagaaggatcaagacctggaaagatgggtaggtaggaaagcggcacatgacacgtcatctatttagggctgcttctgagaataatatcaattttatatttttagcaatgacccaaattagtttgtgggcttactttttttgtcaattgcttttaacctaaatgggactggtaacacaatcacagaaaaattttgtcgattcagaattcctttgtaaggcactgtacttggcgtagtgaggagtgcaagcatgattggccataatccctgccctgtgatgactctcttgtaggggaaaaagacacagacatgatactgacacaatgcagagggtaacaggactatgtagactacaaaggcttctagctgagtttcccacactaaagtctttcctgtgtccccttcatgagtttttcccatctgttctcttatgtgtttcatattattgctttttaaaaatgacacatgctttccttgatttttcaaatgagagtgcatattactatgatagaaggaagtctgtcttcttttacaagttaatgtacatttttgactattaaaataatttataagtaaatatccatgagtgtgcaccttatttaatctcatgtactgcactttggaacatgtcagggaggctgctggtctcctagaaggctttctcaagcagatgcaatattaacagggccttgaaggaagaaactatttcagcaggtgcaaaatgatcacatatacttgagatgtgatttggtgtatgtgaccatgtatatttcagatgtgatcagtgtaaatatgtgaggtggcattgttcagatgtgatcagtgtaaatatgtgaggtgtctcaatgcctaaggattccgtgggagtatagagtaagaggtaatgcactggtcccttgagactgtgctttttactcctttttaggttgtttgcaaagaaaacatcatgagactagatttcttctccatcgtctctcctcttcattgccaagtttttcaggcattattactacatcgttgttagttgtttgttgggttaatctatgcagagctatctgtaagcattagaaatccttcctgtatcccaagtcagggagaggcagataagaagggccatttatttgttcgttcattcattcattcattcattcattcatgtatgcattcattgttgcctctgatgctagagttagacacacagagatgcataagacatgaccacccaaagacccgggcggttggggaatcacctagaggccaagcatataatgagtgttcaggaaatctttggatgaatgaataaatgatgcctcccaatgtttctccaacttggctgcatattggagacaactagggaatttttgacaattttaacttcccgcatagattctgatttcattggtaagggttgagacctaagcattaggaactccaaaacttctctgcatgattctaatgtgcagccaagtttgaggccactggtgcaacccatgaagatattttttttagagtgggatagcttaatacaaaggacttttagtaaaagcagtacttggaccttagttggaaatggacttggagggacccaggcgtttgccatttaggtgtgggtacaatttagtcctttcagaggggtcctgtaagcattaagccctgcagttttcataatgacacacctcatttcttagagaggcccagtttatgcttcttgtctgtaaaggaactggttactttagcttttgaattgaccttaaaacccctaaatgtgctcacatcagccttctgggcagaacatcgatagttcagggtcaatcttgagtacacactagctgttgggaaaccttgttgggtttccaactaggaacatacaatcaaagttacatttcctttcctttaggggaatcaaaggtaggagaggaagttcatggggcaatttgaagagtccataaatgcctgcaagctgtgaagagctctataggaatgatacgattagagatcaattctttttttaaaaaaagttaatacttcgggaaaattgctacattaaacctgtgtgttctttgttatatgtggctttaagcagattgctttactgattaagatctagatgaggctttaggcaagaattttaagagaactttgttattgcttatatgtgttcttcctcaatgaagaatgatggcaatttcactgagaccatcaatgtgccccattgaataggccaaggtatatctttgaagcagagcatgctttcaaattcacttctcattttattgtgtacatgcccacaaaggcgagttttttccatttttcctacttttttaccaccccattgatgaaataaagaagtagattttaggacgagctttattattaagtgatgcttcacgtgctggaacatttgaattaacaatccttgctgtgtgtgtgaagacccagtgtctgccccatggccgtgtctgttttgtattgagttccatgtgtgcaaacatccatccatatcttactgaccatttccttaccggttatcttcctttcgagtaatttgcaagttaatgtcttccttgatatcaggatcatagaatatacagaggaaatgtataaaatggccagaagttgcgcatgtttatttaccactgtaaaataaaacactgggttaaccaaatgtttggacacacttgaagtgcattaaaatgcctcctttgacagtgtccttcaataacagtaacccgtatccttttatgtttatctgaaacagattcagccacatcttctccaggcttttgcctactttctaagcttcaccttcaatggtgattctgaaactgatgttaaaggaagtgtcaagtttttctgtttctttttttgtttatttgttttgtttttttctctggtgcatccgcttgtacctttttattatattaacttcaagctaagacttttttaagacacaaaaaaagtctggtaatattaagctacattattagctatctatggagtatgtttgatgtcttagttgtctatgacctatgttacaaaataaagtgccttaagaaacatttattatctcacaagaatgccttaggagctttagtgcagcttgatagctggttctggctggagtcactcagaaggctgcaagcagggtgtctactggggctacagttgtctcagggcctgactaggataggatctgctcccaagctcgcagagctcctggctgtcttcagaagactcacttcaaagatcattcatggccgggcggggtggctcacacctgtaatcccagcacttcggaaggccaaagcaggtggatcatgaggtcaggagatgcagaccatcctggctaacatggtgaaacccagtctctacaaaaaatacaaaaaattagccgggtgtggtagcaggtgcctgtagtcccagctacttgggaggctgaggcaggagaatggtgtgaacccggggggaagagcttgcagtgagccgagatcatgccactgcactccagcctgggcgacagagcgaggctctgtctcaaaaaaaaaaaaaaataattcatgtggctattggaaggctttagaaccttgttagttgttggcttaaatatgtgtttctttatgaaaccactcatgacatggcagagagaggaaacagagaaaggagaacgggagagaggaggagggaaggagggagggagggaggaagcgaaacagaaagataaaaagggagagaagagggaggaggaagggggacaggaggagagaaatagaggaaaaaagagatcaggggaaagtgagaagaaggagaaagagagagatgattgggagatagaaaaagagagggtttaggggagagggaagaaaagggagggaagagcagaggaaaaggggaaagggaaggggaagagagaaggagagaggcaagtaaaatggtagacttagtgtaacagaatctcagaaatattatcacatcgcttttgctgtactctgctagaagcgagtcactaggtccagcccactctctaagtgatagggttactgaaggccatgaatgacaggaggagggagtcactgagggtcattgtagaggctggaggctgcaggctgccaataattggtctttaaatatcaccacagcagtgatggtcttatgcagatgttgccagattttcttgcatgagagatatcaagttttagccctttgaagatttacagtagtaaaagtcacatattaagtatctaagtctatcttacattttccagattgacagctgcttactaatgaatcattaattgaacttggggtagtgatcccatcttcttccttgttaagttcaatgaagagactctgaaggacagtgctgtgttggatacatgcctcccagtttgtaggttgttccaaattgtatggtcttccatcttttccacagttttgagtatattctttaattttcttattttaaattaactattcatcatcctgaccgaaaacataatttttaaaatatcaaacttctaaaaaataaataccactaaaactttcaaaacaatccagacatatttttcagcatatctgttattcagaaactctatggtaggaaatagaatcaagcgtagttgtgtgtttgtgaaccaaatatttgactgaacaccatttcatcaggaatctgaatggatttgtgagctctgatacatttgagtataattaaaagtaaaaagttaatacagacctgacatcaaaagcatgatttctaactgaaaaattgataaattgaaccttattaaagttaaaatttttgctctgtgaaagctcaggcaaggaggatgaaaagataagctacagagtgaaagaaaatatttgccaaccatatatatgacaaaggactaatgtctagaatatatcaagaattcttaaaactcaatgacaaaacaattagaaaatttgcaaaagatatgatgagatatttcaccctcccgcctcggcctcccaaagggctgggattacaggcatgagccacccccgcctggccatgcatgatctttgcagtgggtcttctgaagacagccaggagctctgtgagcttggaagcagatcctatcctagtcaggccctgagaggactgtagccacagtagacatcctgtttgcagccttctgagtgaccccagccagaaccagctatcaagctgcactaggctgtacagatggcagataaacacttgaaaagatgttccatgctattagccattaaggtagtataaattaaaaccacagtgaaacatcactacatacttatcagaatggctaaaaagaaatagtgacaatagtagtacaggtgaggaactggaccactcatgcattgatagtagtaatgtaaaatgatgtagccgctgtggaaagcagtttgatagttctgaattccatatgacccagagattgaactccaaggaatttaccccagaaaaatgaaaacttatgttcacacaaaaacctatacataactgttcatggcagttttattttaatagcaaaaacctgaaaatagcctagatgacccttaacgggagaatggttaaacaacattcaacacaacaatagacccatatgtatatcacatgtaaactacacagcaacaaaaataaatgaactatccgtgcacacaaaaacttggactaggccgggcatagtggctcatgcctgtaatcccagcactttaggaggccaaggcaggtggatcacgaggtcaggagatcgagaccatcctggctaacacagtgaaaccccgtctctactaaaaatacaaaaaattagccgggcatggtggcgggtgcctgtagtcccagctacttgagaggctgaggcaggagaatggcgtgaacctgggaggtggaggttgcagtgagctgagatcgcgccgctgcactccagcctgggcgacagagcgagactctggctcaaaaaaaaaaaaaaaagaaaataaaataaaagaaaaaaaacctggagtaatttccagggtatgatggcaggtgacaaaaacagtcccaagagattatatattgtctttttggaaataacaaaattttagaagtagaaaacagattggtggttcccagggatgaatgatgaggtggggaagtggggagggaggtggttgtggttctaaaggagtagcgtgagaaacccttgtggtccactttaatttccttatggattatagtttgcctaccccagggtcagaaacattctattttatataaatcttattgtttaccttttacatataggtctatagtaccctggaattgactttgtttatagtataaagtagggcacaatgttgaaggttattttttcatatggatgcctaaataatcctaattgttttgttgagaatacacttctcctaccacagtgaagtgtcagctgtatcacagatcaagtgattatcaatatgtggatttgtttcttgcctccattgtttcttgaactgtttttcaatttcttaattactgtagcttaatacctcattttcttaattattgtagcttaataataaatcttaatttcctaaaaggtaagctctctaactttcttttcctttttaaatattgctttgaatattcctggccttttgcatttttatataaacttcagaataagtttgtcaaattgtctagaaagcctgacagatattttattaggatagcttatacttcaacataaggagaatatacaactttacaatattgattcttctaattcatgagcatggaatatctctccatttatttggatctttaaaaatgtatcccagtaatgtctggcagttttcagtgaagaagaatacatgtatatacacatatgcacatataggtatatatacatccccagatattttaatactttgctggtgcttttgtaagtaattattcaatttgtttgttattgaagtagaacagaatgcagtaaaggacataaagtgcgttaaccttatgtggatagctcaatgtctttcatatacatgtacacccatattaccatcttccaaatcaaggtgtaaattattgtggtacctagtttcatcatgtttcttcccagtcgactactccttcccctagaggtcaccattattatgatgtctattaccattgattgggtaaatggcactttttaaatttcattttataattgtttatatttaatctatggaacttttctaaattaacttgttaatttttatcataatttgagatttttaaagaattttctacacacacaattatgtagtctatgaataatgaaagctttattacttcatttccaacatttatttcttttatttctttttcttgcctcattgcattggctaaaactaccagtagaattggggaaatcagggaaaagtgtgtagtattttaccattgattatgatgttagagtaatgtgttagataccctttgtcagattataggactttccttctatttctagttttctaaaagttttatcatgaatggctgttgatttccatcaagtgcttcctcagcatctcttgagacaactatgtgatttttatctttcagtttgttaatatgatgagttatactgattgattttctaatattaaatcaatcttgtagtcccagcataaacttaatgtggttataacctgttattcattttatatatcacaggattggcttggtaatacaatatgtaggattttagtttacgtgtttacgagggagattggcctaaaagtttcatgtgatatctttgtgaagtcttggaatgaaagctatcctgggcttgtaaagtaagtttggaagtaattcttctctttggagtctctgaaataatttgtgtaaaggtgatatttcattgaaaccttttgtgtgtgttaaaattcaaacctacccaacaccttcaagcaggattttgttccaagatgttctagctaaagacttgctttctatgggcccttggaaatcactgtatatgtcattgagttccctgggcctatgcttgagaaatacatgaataagatgttagaaatacctagaacagtgcctgcaatgtcataaacaatatatttaccttttccttcctgtttcctcatgttctcttcctctacagaagcacctagaggcagtgacctgtggtagacaacagcatgaagccactaattctattcttggagcccagcgtccatctggcttagtcagaatcatggcttttggagacagggacagaggtctatgggaccttgcagaattgtgttgtttcgaagtcctttcccaaagagcagtgagttaggctgtgctaagtctctcttcaggcaagatacggcaggggcagaggcagccctaggggaatgagggaggatttggaagaagctcgtttttcagttcctttgcataagggagggtgtcatctcttaaactcttcccacaaactgagtaggctctatggataagcctcttaatccatctggacaccccttcctgacacttcagagcagtcgatacttctagtcatttctagccatttcagcagcttacagactaattatgcatctccccccttgcacatagggataggccaaggagaagaatttgcaaaataacaatatctctaaagccacagacaccttctgcgtaagcctttctttctgtggctggtagcgtagcaactgacgaagcttcctggactcaggttgccctgaattgcatgtttcttccctcactccctaccaccccctttctctctactttgtcatcttgtcatatttgttctgctatggcagctactgtgtttttcctccagtgctttctgaaagtgagttgcctgtcctggtgggagattagtggctaccacatgcataaagctgacattgattttatcgaacgtgatacatgtgatgcatgagcccaagatgccctgagagctcagatgctcagagggggcatctcaggaggctagaggcgctgggctgaatggcccattacaggagaaggctgtggaatggggagaaagaccagtgcaggggtccaaagctaatagccatgggaagaaaggaataactcacgtttatgtagggcctgtcatttttcaggcacttacacttgatcttcacaaggacccagtgaggtatgaccatgaccctgattttacatgggaagaaactcagccacaagggagttatatcacttgcttaatgtcacaccattaaataatagagattgcaaggcaacctctgtctgacccagtgatcttttactttccagtacacctcacttccctttgtaagtgaaagtgaatatgaaaatgcaaagggatgaagtgtattgggcatagtttggagaagctagcatagagtactggggtactgcacagggaaattgaggtagacttccacttatgtgggctgcgcaggcattgtggaggtcaaggggagactcacccagcatgttgaacactagctttgtactggtccatatgccttgctccttacattcaatccatgaccaagtcctgtcctttcagtctcccaacccaaccctcggcctagttcctctgcctctgcctctccagccccgtggccattacttgagttatgcctccatcatttctttcctcaatgtaattgacacaacttccttattggtccccctgtctgtttctctcccttagacccattattcaccgtgcactcagaggagttgtccctaaaactcttgtgcctacgtgacaccactgcttacacagcctcaggatgaagaccattcctgatcaggtcacttttgacctctctgattgcctttttgctggccccccacccctgctccccatcacctgtgtttcagcaggatataccatccgtgcatgacccagtcttgtctttgtgaataaccccacccttgtgcctgttagactctccttttcctttaagaccaagatcatgatttgattgctctaggaagccttccctaacatcctccatctaatttggatatctctccttgtattagtttttgattgctgctgtaaccaatcacaaagttagtggtctaagacaacacaaatttatgatcttatagcattggaggtcagaagtctaaaatgggtcagtggggctgtgttcctttgactctagggaagagtccattcccttgccttttgtagattctagacgtcaccagctttccctgcctagtggtccctttctccaccctcacagccagaacatagcatcttccaatcgctctctccgactctcctgcctcccttcttcacttatccaggatactacatatccaggatatgctccctactcaagatccttaacttaatcacagcttcagagtctatacaagttttggagtctatgtaagttttggggattaggaattgagcatcttttgggaccactattctgtgtatgatactgaaatgagagatttcccttatctcccttgcaggatgtgaaacgggtgtggctcactccttcagttgcccactgtaccagaagaattggatcacatgtgggctcaaaggatgagtgcgaggttttatccgtggaggtggctctcagtgagatggatggggagccagaaggggaggatggagtgggaaggtggtcttcccctggagttgggccgcccagtggcagattcttatctgactgcctccagctgaacccccctcagcgtccagacatcctttctcttctgtctttctctgccacattgttccattgtcactggtctgctggttccaacgttcagccacttgtatgtgtgcccactaaggtcttgggtttatatggggacaggattggaggtatggtgggccaaaaggcaactttttgggtgcgaaaacagaaatgtctgtgctgacttagctctgtgggtcttcaggcttgagggtggggcccttactggggaaccaccctcttctacccagtgcttccctgtcttctgtctgtatcaataccacacaactgtgtgagtccacaggactctgggcctgccacttcccagcctgtatcactttcttctatagctcattggtttctgcatccttccctagtctcttagtctcctccagggtagagacagttatttgctttgactccacatccccaaacatagcagagtcagccctcattacttgttagttaggcagaatatgatatctcccagccttcatgtacctgcctcactgtgtcgctgaccagggtgctgagaacagtggggcatcagctcactgtgtgagttaaaatcatggcctctagagcaagacagcctgagtatcccagcacactcactaattagccacatgaccttgggcaatttgtaccttggtctcctcatgtgaaaaataaagataattataatacctattgatataaatcacagtccaggagggaaaccctaaatcacaccaggtatttcaaacagagggtttttattgaagggaatccattacacagtgatgaaaggctgtcagtgcaaaagtgggacgctaaggtagccaaaaatggcaggaagtggtgaccacacctggggctggggtaacaaaatggaataggaggggttatggtacctagaagtctgtaggaggagcacagcagggctgattctgagacctctgaggagggagaccccacagattgtactgcagctgtaaggggcatggcctaggttatattagttccttcagaaagatactgtgccatgggtgctacaaagaccagaaaagatgaaggcctggagcgtagcagcccctgttgctggaatgatgctacaaggaccttgaagcagaaagagagcatcttcttccttcttccagcatcccagtctccatctgaagtctcccatcactaggactggaccaaagccagctggcaaggtagtttagagatgttgttagtggggtcccagctccagaattacataactgatgtaacagggtgggcttgaggcaaaaagaccagagctgaatactagcacactcctttagtctcctcatctataaatgcatactagaatagtacttactttccggtgtgatatgaggaataaatgaatttgtatgtaaatcccgaaatagagccaggcacgcagtgaacattatgagaatgttatttgtccttgctgcgtgacagtaataataacagctctcaccatcctgtgggtgtacagacgtggttgtctctggaactcttaagatccaaactggataaggcaagagtttctttcaccccattcttcatagcagggctgcttggctgaggtgggggaggggagtgaagggtgcccatttgtgaacccatgctgccctggaacaaggtgctcctgaagcatggcctttgattccaaagctttagaatccagcttctcctagcccctcctttggaggtgacagactcttgattcatgctttctgaggactcctgattagcaggcaaggaaaggaaggctcttctagaatgtttactctgctcttaattttgggaagtggcccagcaaagagtaatcttgaaaatgttgaggttttgggggataagggggagccggggcagacagagtgttgcagatcataaaacttcatctggtgctaagttgttattgaattatgcatttctgaatgacttcactggttgcaacatgatgttgttaagtagactgaggctgagctcttaaatttatttgctggtaggagttttggcaggagtacacactgacatgactgtagactgtcttgatcctgacacaggaaggggaatgcgtttgatgggatctttctgtctctctgttgggggggcacaaaataagaatatcagttaaggctgtcactgacagctgaatggctcatcggtggctggttgggaggatgatgatattagtagcaaagacagtttacttgttacgtgtaggaactgttctaaagtatcaactataataatttatataatctttatggcaattaccatgaggaagatgttactatatccccagtttacaggtgaggcagtttagacacaaagaggttaagtaactttccctcgttttcataatatgttagactggatttccccaaaaaacagatcctttagcatggatttgcgaatagtttatctaagttgtagggaacactggtaaacaggagacgaagtgagactgagaagaaagaaagccccttaaagagtgcactatgggctgagcagggtggctcacgcctgtaatcccagcactttgggacactgaggcggatggatcacaaggtcaggagatccagaccatcctggccaacatggtgaaaccccgtctctaccaaaaatataaaaaattagccgggcatggtggcgcatgcctgtagcacctgtagttctagctactcaggaggctgaggcaggagaatcacttgaacccgggaggcggaggctgcggtgagctgagatcgcgccactgcactccagcctgggtgacagagtgagactctgtctcaaaaaaaaaaaaaaaaaaaaaaaaaaaaaaaaaaaaaagagtgcactatgagctggaagtgctagaggatatctggtgctcagtcccacccaggaccatctaaaagactgaataaagccaccccattgtcccactaggggtcaaggaaacctggatgtttatccaccaacttccatccctcactgggtaagggctgctcctgggagtggtaacacctgggcttgcgggtaggtgggaagtgcaatgcctgtagccacagagcaggcggtattgacacagctgctttctaggtaaccttggtgtcctcatctgtaataagggtgtagtactgtctgctttgtgttgtcactatggagagaaaaatgaggaaacaggtaaactactgtgtggttgcaatgattagaggattatctgaaagtcaagtgtcaaaactcacagtggaggtctttgagggggtcccagaggtagccaggatgtctccttgttagtgaactattggtgaggaacttgctgggaaaatggatgtaatcgtggttcttgactcctgctacctgggcagataggaggggagattgactgctaaacactcctagtgattgagagcagagaactgcaagagaggtcacatccagatgtaaaagcttgaaatatataaaaaccttacctatttcaaatgcttatatttataataagcaactgatgcaggtttactaggcatttgtaaaaaaatcaaataagaaacagaataaagaaaaaatagtacctatattctcataaccctaagaaaaacgtcagcgttttcatgtatttaaatctagatgttttaagcttaggtagatgagatttgtttgttgaatttagttcagcaaagtgaaggagagactttttcataggaatttatgatgtcccttttcaggatgatggccgaagctaaagttaaccgttcataatgaaattgcttgtttttaagcattccctaaatgctgtgtggatgaaaggcatgccattctgccccttcttacagattgggctatgtgttcacttcagtctggcacaagatcatgctcctcttctagactcacatctgagaaaggagggtcttgtggtagctaaccatctcataggactgatcattcttatatcacaattcccctatgctagaggtcatgattttgattcatcacaaggcggactagggtaaatcttcaagcagtttttctctaagggaaggcatgcacatagcattttcttctctgcgttcttcagaaactgagagcattttttctgctggctttgaaaatgcaccacaactaacctcctataaaactcttgggactggaaacatcccccttaagaccttttgtgtataccattgtctttatcataatgtaccattgtctttatcataatggttaggagtgcagaccccgggcatgttgccttggcctcagtcctggattttgaatgactaactgtttgactttggatgggtatctacccacccataaagttgctgtgaagactaaatgaatcaatactgtagaacactaagggcagtcagaggtgtctgaaagtgtgcagtacatgggagctgccccatggtgttatttgtgattattctcatcatcctcttcctcatcacatcccagtgtttgaaactgtaatgataaagtctggaaccagagtttttagtctttttattttgttttgatagatatctgttattttttctgaaggcttatgggaatttttctttagttttatatttcaaaaatattgccagtatgtacttaagctcaagtctcatcattgattttgcctggaacccactgtgctcttcagagtctgcaaactcaggcctttgggtatttcagagaagttttctttacatatgtctttgattgttgctttctgtcagttgtttgatgtcttctctctaaatacttccaatcctttgcttagaggtgcattcagtattctctacaacatcgtacttcttgttctttttcatctctttgttgccaccctcaacctttcactttgggaaaacttatcaaatattttttctacccatttaagtaagacatcagatatttattgaccactggctgtatgtttggttagggcacaaagactaatttttttttttttgagacagagtctcgctgtgttgcccaggttggagtgcagtggcatgatcctggctcactgcaacctctgcctcccaggtccaagcgattctcctgcctcagcctcccgagtagctggaattacaagtgcttaccaccgtgcccagctaatttttagtagagacagggtttcaccatgttggtcaggctggtctcaaactcctgacctcaagtgatcctcctgccttggcctcccaatgtgctgggattacaggaatgagtcaccgttcccagccaacaaagactaattctgattggcacctactggaggatttgatgctatatctacttaggttgtgtccaaggactgtgagcccaagccagggaagaatgagaaggctgggctactgccgattgctcactgttagggtagtcattcagtacacatagaatccctgtggcccttggtagagaaaatttagggacttttatgacttgaatctttcattgtcaaggtaaaataaatttgaggaccatgaagattgagtagagtcacacatctggctagtggtaagccaaggtcaaggaaagcttgaaccctggccccaaggtagtcctttttgatcctcagtccattattgtatgaaaacagtgttgcgcataaatcgtagaaagtttaatcagcattgaacatctactctgtgcctagccctgtgctacacgaaagtaagtcgtcatgaagcagttttgaaaagaaaaataggcatggtttagttaaaagtaattgaaggctgggcatggtggctcaagcctgtaatcccagccctttgggaggctgaggagggtggatcacctgagataaggagtttgagacctgcctggcaaacatggagaaaccacgtctctactaaaagtacaaaaattagctggacgtggtgacaggtgcctgtaatcccagctacttgggagactgaggcaggaaaatcgcttgaacccaagagttggaggtttcagtgagccgagattgcaccactgcactccagcctgggtgacagggtgagactctgtctcaaaacaaaacaaaacaaaacaaaacaaaacaaaacaaaacaaaacaaaaaaaacaagtaaaaggaaagccattctagttgggaaaaatggcacagacaaaagtctggaaatgagaatggcacaaccgtgtttctgtctgtgtatgaatgtgtttgtgttggtggctagggttgggtgggtggaggcattcccacagacctggagggtcagtgaatagaaaatgcagttaaaagggtgatcaggtggggtgagacgtgtggtgtaaagtgttggaggctaggttacactcaccttaatcatatcaaggctcacttcacgtcttagtaacgtttggtttttctcaaaacgtttgatttctatctagagcagacagtacatgcgcacagctccatctccagctatttgaaacacttttactctctgtaggaatttctagggagtcaaactgttacaagtgctcacagcagggaaaagaaagacagaattgttctggagattgatgcctgaggatgtggcagaattacaggaaggggtcacttcaccatctacatgttgaaggagagccttggaagctcagggccgctgctgcccaggtctcatggatggctcctggcatccttgtcctcgcagcgctttgatgcctggctggaaggcactgatgtcatctcccagctcagccctcagctccatgaaggcaagacttcctcctccttaatttagttgcaaactttgtgagcagagggtgctgtcagatgttaaacacttactcctggctttgcacagatgatggtgtggagtctgttaagagggcattggttgtgttagaagtgaaaagcctcatggataagaaactggtgtgtgcctgaacaacctcttgtttgaaaaactgttaggaattcaagcatctgatggtgctgataagagggaatggtataggagtaaaggctcattttctcccaattttctgaggttccctttcaggtaattagtggcattctcttcatccagtgagtcacatatccatatttttgttttttttaacttttaaggtatcacttatatgcataaaaatacttctgtttaaagttcacagtttaatgagttttacataaccccagttaagatacagaaatggttataacctcccaaatttttcttatgccttctttcaggcagtcatctcccttatagtaacactattttgatttctgttatttaattacccaaatcaatatatagagaacattctaacatcccagaaacttccctcaggctctgtcccggtcagtacctgcccctcaggtcactatgcttctggcttttatcaccatagagcagtttttcttgttcttgaacttttcacataagtggggtcatcatgcattcttttatttttcttttgcatgaatttttttgagatttactcatgttgttgtgtgtgtctgtgtctgcagcttgttcatttcttgctgagcagcgttccattgtgtatatgtgtatccctttatggatccataagctcttacctaggtctggctcccagggcctctctattctcgaatgccctccttctcaacagcttctgagtcagcttccttctctcctgacttctctttgtcaatcctcgagtgaaggctggaaggggagctccatgcagccaagattgtgtctgtgcctaggacagtgtgtgaccagcagcagggactcaacattcatagaacgagtgaatgaatgagtgtccagggcacatcgtttgaattgttgaccagtgtagcccaagcaactgagaactaggggacccccaggaatttttctttgttcatagactcaacatgagtggtcccagcagaacactcccctaagtgctctctgcaagagcttccctaacctctagaccagattgggtcctttcacaggcttcaaaactgcctctgccacccgcatcatgactttactacactttgttatcactgatttacttggctgcattaaatttcatgcgctcagtgctctgtctggcaaatgagatacacaggggtttccttttcctccctgctgactctagccattggactggatggccctgtacatttcctatactgtcttcttgaagagttcatcttagagatagagaactgctataaatagatagggtttgtctatgtatttttaaaataatgtgctgcttaccaaaaacattctgtgctatatttttgcttctctctctttgaaccaccagtacctgtgccttctaaacaatgccaattatgaatcaatggatcactgaaaaaagaaagaataaagcacacaataatctgatggcttccttggtgccagatagaggaaacaccgtgataaacttacatggtctactcttgaggggatggagagagagataaccgtgaggctaatctgcacacaaatgtgtgaagtcgcaagtcatttgagatagggacatttatatactcaaggggatgtttgttactatacttgcacatgccattagaaatacatgaaaagaagctaaccatttggaaagatttaatactttattttctttctggtggtcagcaactgaatactgctgtctgaaataggagagcagaaaaccatggtgaaaagtcaatggaaaagaactaaatggggccactcactcagcctccaaactattgaagtctgcaactcttaattctgtagaggtctagtctgtgaataattatattaaggaattgggcagagtcatcacagagctgcaaaatatcacccctggggcctcattggagactgatgggagctctggagagttgataatggcaatcaaaggttccatatatttaacatgcacaaaggatgagcttagaaattatctgcctgccaacctagcttctctacctggaacaaattatccaaaaatcaatttgcaaacacctttgagataacaaggtcttgagtaataacctccatggctttgtaaagaaaagcatctagcttgactaatctgcttaatttccttctctgaccaaatggcaggctataatagaggcaatctggagttgtcccttaagatttgcttcgagtcacactgagaaaatattgtccacccctgtttcatagcaattattctgtttctagagaatctttgcttctaggtaattaattggaagggaaatgcttagtgcgtctctatctcaaagcccttacctgagttccaagctaaaatgtatacctaccttctatccatgtgaataacccagaggccctctataagtgaaatattctcaaacaaatgcacattgtattctaccctcatatgcctcctctgtgcctgccctttctcctcttccttgttctactcttcatttcctcttgttcataccctttgacatataatcccattcctcgcagttggttctaagaaaacatgagataagacagactgaagtctttgcacaaagatgttcattgcagcattatttaccatagcaaaacatgaacaactcatgggtccagcaatcagagaatagttagtgtgataacctgatggattgttatgcaaatattaaagacaatgatgataaagctcaagcagtatatgaaaaaaaaaatccttacaatataagtgaaggaagaaaaatgaatctacattgggtctatgtgttattataacaacacaaaaaatgtgtcagtacataaatattggaatggacatggaagaataaaaatggctatgttggatgttagagatattttctctttcttccatttttctccattttcttccatttcttctcatattttctctttcttccattttctttattgttctgccatttttactgcaaataaaaataacaaatatattcagtttgatttttttaaagatgagtattaagaggcagacagctttccttggtgcaagttggtccaggaaggcatgcggatataagttttatcctacactaccttctccatgaccttggttaggtgacctgatttcttaggttgtcagtttttttttttttccccattaaagttaaggtgataatgctgtcccaagaattacatgaatgatacgtgtgagattttaaagtacataagaagtacaaggtaagtgttaatttttgtagctttgccatgggctaataattgcaaggaagaggctacaatccaagcctgctgaacctctggtctacttagctgactgcgtggaactcagtggaagagaggtggcagcacagagtagatgcacgataactcagcacaacttttcctttaacccctcattcctgctgggtctgctgtgacccatgactttctctgctggaagaaacctgctggggttgaggcagaagctgaattcttgctgtgccatcattctttttctacttaggctcatatcactttttggaaagaacttcactaacaatctgtgtgttctatgtaagaaatgtttatagacctcaggctcccctggttttgtgccaaactttacttcagcaaaagcaggttttcctttgaggctagaaaacagagtattcacccagcagctttgctgtgttctgggaaaaccatttcctcacatggccttctttctttcatttctttaaatgaaggagataaggtaggcattgaatatagctattgaagaaatactgattcaggtacttacatgcaaacccttaaagtagggcatgaatgggatttaaaagggttttcaggccaggcgtgttggctcatgcctgtaatcccagcactttgggaggctgaggccagcggatcacctcaggtggtctggagttcaagaccagcctggccaacatggtgaaaccccatctgcactacaaatacaaaaattaaccagccgtggtggcaggtgcctgtaatcccagctacttgggaggctgaggcatgagaattgcttgaaccagggaggcagaggttgcagtgagccgaaatggccccactgcactccagcctgaatgacagagcaagactccatctcaaaaatataaaataaaaataataaaataaaacaaaaaggggtttctgactattttttttgtggctacatcaagaattctgtcccttgtcgtcatgtgcttgtagtctgctctgtaaatcatttgaatctgacagtcctttttgattgcttgtcttacagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcaggtaagattttttttttttcccaggctccattatgagaggctgtgctattgccaagactggctttcctcttgccttcctgtgacagataattccgaattttctttgaatgtgaatgtgcttcctattgtggataaacaggatcaaggccttggggttttttttgtttgtttgttttttagaggaccttcttgctgtggttgcatttctaggggctttctagctctgactgtgattctaagaacttcctgactttagctgggtcacgggaggttcctggatctaatagtgtttctgatgagacacactggctctgtgtcttccagaactcctggtgccatttgtatgtctgaggctttctaatgctaataatttctccgagggctcttggttttgtctctgggggccctggccgtgtttctctgagggttcctggctctgtttctctgagggctcctggctctggttgtgtctctgagggctcctggctctcactgtgccccgtgaacgcttcatttagactatgtccttgggggcttctggttttggttgtatctttaatgagtttctaattctaacattgttcctgaggctccctgagctgggcctgtgacccttggttttgaaaattttcttgatggctcctggttctagaattgtctccgaggggcttctgttgccaaccatgtcttaaatgcctcctggctctgacagtatctctgaattgtttctggaactaccttagtccctaagagcttcctgcctctgtatcccctggaggctcctatccctacctaagagtctgggttgggactattcctctgaaggtcctctggattccactctatctctatgggttactgactacacctgtctctctgatattcctggatgccatgtaagagtttgctggctgagattgtgtctaagaggggagagattctctggatccaactgtgtcccaggcctcctggcttctactgcatttctaatcaggggctattggctaacaacatgtgtctcactgtacctctgagatgatctggctctggatgcaactcaagaaattaaactaacttgctctttatttgttgcaaattaccttatttatgttatatctttttttcacaccaagtaaacttttgctgtaagtacttacattttatatatgcacaaaggaatagagactcaatacttttaaactttttgtccaaagtcatagaatggccagtggtacggtcaggaattacacttagattttctgactctcagcttttgacttttggccacatcatgatgaataaaagagagagagagagagagagagcattgtatatacagctggggatgttctagtggaggcgggtgtggctcaggggagcaggcagcatgggtttcagaaaacaaagaggagtcactgagggcatctgggtggaggggaaggacccatcagtacaggaaccatggaacaaacagcaagggaaagtgcatacagctctgccatgacttgacatataggtgcctaaaaatcaccacactatgtcaagttacgaaatgaaaaccacagggattatggaaaaaatggggctaggggccatattcatacttccttagtgacacatcaaaaaagaggggaatctagtaaaactggtggcacaattttatgcacgtgaaatggctaagaaatgcatccatccaggtggaatattcctaacctgaacctcggaaatccaaaatgctccagaatctgaaacttactgagtgccaacacgataccaccaatgaagatgacattgttaacactgcagaaaaagtgcctgtagatgacatggcaagcattggtgatgagcttatggaaggactggagcagtatgcattcatagcagaacaggaaaccaggtcaatttataaaatcagagacgtctaagacaaaaatcattgttaatgaggcagatgactctggaggaaacatttttaaaagccatccagcagaatgcctctttatccctagaggatccacttcctggttcctcaactgcttctgatgtttgttctcacctaagaaaataaaatgtggtgtataggaacccttcatcaaagcacaacatcacagggagaggactgaaagccaggatgtttgttgctgacattcaccagctgatccaggtatctgctgagtctactgtgctgctcagttaacctgaacacattaatatttcacagtattaatgacatatcatttattcttttttactgttaagcacttatgtgtgaataagcttaagaagatgattgcttatcgatagcatatacatttggagtcaggaattatggtgatgacagacaagcacagagttgtccacgtaagtggctaagataattacacctctgctttctgatggttcgacatacaaaaacttggttcatgcacaacattatttaaaatattatgtaagattgcctacgatatatataaaacataaatgaattttgtgtttggacttgggtcccatccccaagatatcgtattaggtataggcaaatattctgaaattcaagaaaatctgaaatctgaaacgcttctggtcccaagcattttggataagggatgctcaacacagatggtatgttaccttgaaaaagacctgaagtttgctgtggaagtgggcatcagggaagttgcagcctgtgagtgacttgcagcctgtgagtgactgtgaagtggtggaaggaaagctgtctgaaattggggaaaaaggtgtggctcagaacacaggcagtgagctgacgggccaggtaggggttggaactgtgtgtgttgcatgtattcgtaggtggctcagttctgctgggtgcaggtttctccttcactaatgtttctcacatacaaaatcacacataagcaaatgcagaattcgtgttgtgctcaaattgccctttcatatattaattgggttggaacaaatttgcgttttcaaagcaagagttgtagtggaattagctgtaaccattcttaagtatctcagtggtgtatcgtggtagtatgtaacccaggtatttttgttgcttggaaatattccttgtaaggttattgaaccactatgctgaacagagatgccattttcttgattattttcaaaacaggcctttggtaaaattcctcattgaaacctgattatgaaacttactactttaaaaggacataatgatatgttactaaactgggtaataccttatctcagctttgcaatgcaatattcatccataaaaataattgatttgatcctgctgatgagacttctctctttccacagggtaaatgtaagagtttccagggtttttgatctttataaatgatattcaaagtactttagcagcccccgtggacttatttgctgatgatcatataatacattttgaaattcaatcgcaagatgatcatctcaataaagatttacagtctattgcaaactgttgccatgactgtgtaatggattttacatgttgaaaacacaataatctggctatcaatataaaaattatgagttggaatgcaattgtggtattttatttttaaaaaacgttggtgtttaagttacagctaaaatcttgaataattcacattttacaaaatgtgtcatcaagaagataatcttccttcccgcatcgccactgatggtggaatgttttttgcctcgtaattaatttttaagagaattccagggctggtatctatttgtaggtggtgtttattggtgttggtagtctgagattttcctccttttcctattctattattaatcacgctggaaatgtactcattattttacaaaacagaaagtgagagagtatgtagagtggaaggtataatttctgcccagaggaatttacaggctgggttaggattccaacaaaacagcaaaaaaaggtaaaacataaaggcaagcattgaaatagcatgcttcatggaggaaaaacagcgtcagcatggaaagagaaatggtcttagaatcatcttgggcggtggttctcaaagtgtggtccctcgaccagcagcatcagtattgctatagactgaatacttgtgttcctttaaaattcatatgttgaaattctaaccctcgaaatgatgatattaggaggtggggcatttgggtactaattatgtcatcagggcagaatactgatgaatgagatcaatgcccttacaaaagaggccccaaaatgctccttcatgtcttctgccatgtgaggacccaggaaatgggccctcactagacacttaatctgctggcaccttgatattggactttccagccctcagaactataaaaagtaaatttctgttgtttataagttacccagtctatggtattctgttactgcaacctagatggattaagacaaatattcccctgggaacttgttagaaatgcacattctcagacctgtcccccgacgtaataaatcagaaattctggggttgagcctagaaatttgctgtaaggattccactgagtgatgtcatttcatacccaagttttacactaacttatgtatagtgacaagccaacatggctctttggaaggatgttcattccatagcttggtctttgcagcagctctgagatgtagatgggaggaaaactgagactcagaatagttggatgaaggtcaccaatcggttaaatgctaggtctcttggccagagaaactcttcaccacaggacttgatggagtcttcagccctggggacctcctctgcccacaagtgtcctcttgagagtggcattgggtagtaaggaggttggtgactatggagatcagctgagaatgaataactactacacaaaagtttcactcctttctatcaaacatttacttagtcttttctttgtgccaaattctgtgctaggcactggtggcagaggttggcttagtaaggacatgctagtagcaggcagagacttggcagcagtaggctacaagcttgggcgtagcacaagaagatgctagagaggcaattcagctaaggcaggtggggatgcattctggctctgccagttttgagaggtcactgattaagaaaattctggggtactaagggaaggctatccttcccttaacccaaaggatacctcctccttaacccttaagggggagattgtcaagtgtttgcctgtagcgcagcatcccagcccagtaggctggagttcagagcaagactcccagccagttaaaccagaaactgtacagatgatcagataggaatcgagggatgtggggttgggagtagggagtcaaaggtgatactcccatgcttcagtttagatggctgagagatgagtggttgtattagtcagggttctttatagggacagaactaataggacagatgtatctataaaggaaagtttattaaggagtattgactcacacgatcacaaggtgaggtctaggctgtctacaaactgtggagaaaggaagccagtccgagtcccaaagctgaagaacttggagtctgatgtacaaggacaggaagcatccaatatgggagaaagatgtaggccagtagactaagccagtctagtctttacatgttctgcctgcttttattctggccatgctggcagctgattagattgtgttcacccagattgagggtgggtctgcctttcccagtccactgactcaaatgttaatcttctttggcaacaccctcacagacatacccaggaacaatgctttgcatccttcaatccaatcaagttgacactcattattaaccatcacagtggtgaaacaattttctgagccgaaaaacacaaaaggaaatgagctcaggtctgaatatgttgtgttggaggtgaagatgtatagcaggtgatgggaatatataaatctggagctcaggagagatcagcagataactgcctcttccatgcggactacctgatttcacttggactttaggatcaaagggacttcttagtactgatgaaagcaatttaagtctgtgtcttcatgctgttctgttgagataatccatttcttatatttttatttatcattttgtttcttttccttagtttaatcattcaccatctttcatgagatataggtatgagagcaaatgcgatcatgtatatcaaactcaaaatgttctttagctgcctatagtgaaccaaagtgttattggttgctgctattgttatggatgctatgattatgaataattatatcaaaacaggaagtcttccttgtccacttctcagaactaattggcatcttgaaggtggacccatattcttttgttgttcatcatctcctggaaaatcccatttcagagttcatgctgtggtctgggatctcagagactctcttgtctagagcattgtgtggtttcctccagcacatccccaacagcagactttctgtgataggagttgggtcttagaattgctgtgtgttgcccacccagcctcaccttgaatgctgcctctgatgggaagtttacactcttccatggcagaccatttcactgctggagatctcgggtggtgactattatcctctatccagtgttagcttggttatcgtacagctctggatggattatacacagagtgtccattaggtttaaaagagtgggggcagtaggcaggctgctagcattaactattgggagtccacagtgagaaccaagggcagtggatgccgaggtcagtaactggagaaagcaggtgaggtgacaagagatagggacaccacatgggtccaacttggccctgtacctctcctgcaggtaccactttcaatggcttgggtaccagcttgttggtgtcttaagactatcatctagcattagatagaagaagctcttcctcattgttaccctcaaataggcctccttgaaacacccacttgtaagttttgctcccaggttttcctcctcatctcaaaaacaggtcttcagccactcagttgtctcacttaatccccagacattgctttcttttatccccccaaacttcgcttgacgcagaccccaggccactccgattatagttacagaatcacaaatcaacaatccagcaagtcacgtaatcttagcccgtcccccttgcgtgtcaatcaaaggccccttgcctgggaacccacttcattgtagtcttgcggagtcccagctctccaagtgaaaagtggctttgtacagccagagacaccacatacgctgttgatttggagggctctcttcctattccctccacctgagggttgattgcatgttctattttatttacatatttatggatttctacttgcagtgatatgtgtctacctctctcttttctccagggggataaaaaagataaattcaaattgctgggctcaatgaagtgagagtagtcattagaattgaatgaaaaggatagaggctttagagccaaaaataatctggtttttatttcaagctgggcacttgctggctgggtgaccgggatgtgttacaccatctctctgtgactcaatttattttcttccatctaagggatattataatgcaccattttgttggaaagcttcagtgagataagttatatgccttgcagagaaccgggaacttaggggccctttaataaacattatttagaaataaatcttaggcctggggaaaggatgtcagaacctgatttccttcactgtagcatgatggaccctgttttaagaaggatttctctagctgctactctgtgtactttcttagacagtggtggtttagcaacaagctctgatcactgctgagaaggtaagacatgtggctgtgtgcatgttgtggagtcctcgacgtgtagctgtgagggtatttcatgatatagggcacggggtaagggggatgggaattgtcctttttataattgtctctagtctcaggtaagagggagaaccatgttacgcagatgcttctctctttgaggaggccaaggcttgtaagaatgaggcctttcaagcccagagcaaaaagggattggaagtgaatccagactctctgcaataagcagcctcaggtggtctctgtgttctctgaaaagcctgtgggtcccacaggcaagggtctttcagggcaacatgcagttctaggacagagtagaggcagagaattataaaaagaggtaattgaaggtctagaaaatagaacagcatcacttaactagtctcgtgagtttttcttcttcatttctctatgccttggcggcaccatctataaaatgggaggaacataacttggcctaactcttagggttctgaattagaagtaaaatgggacatccttctgggcaggagggtagtatgaacacagacatctaacctccatctctgctgtactgtaattctggtgagatgatccataaatcttcggggaacatggaaacagtagccagtagaaatgaaaatggactcactatcccacccagaatcaaagccatagagttaatggattctaaagaccaatggagaaattttcaagaccatgaggatctagggaaggaggggactttcatgcatgccacaccatgctcgaagggacatagttgcttgtgcagtgcaggtgaacctagattgaaggcagtcacagaagatggattatgaccagcacttcctcaaaaagatgtggagaaagggttctggcagttcttgcatcacctaccgaacttgttttgctgctgctgcactctctgcttcctctgggttgtaggaccacggaagagagatgaaagctaaagaagggagaaaacctgctctgatcatactcggttatggagcctctgattgagacgccataagaattatctgggcacggcgtggtgactcacgcctgtaatcccagcactttgggaggccgaggcgggcggatcatgaggtcaggagatcgagaccatcctggccaacacagtgaaaccccatctctactaaaaatacaaaaaaaaaaaaaaaaaaaaaaaaaattagctgggcgtggtggcgggcgcctgtagtcccagctactcgggaggctgaggcaggagaatggcgtgaacccaggaggcggagcttgcagtgagccgagattgtgccactgtactccagcctggacgacagagcgagactccgccttaaaaaaaaaaaaagaattatccgcagacggacaagcacctgtgagggcataagatgttcatctcctcttcttgcagaccctctctcccctcccactgtcgcacgatgtctactgttggcaccattggagtccctctcccttggcttaagaaagaggcaaaacataaagctctctctctttaaacctataattcataatcccagagactcacttcccctaacccatgaagtctcattattgtatgagctgactgtagtgctgggagggaagagtgagagtccgcttgggaacctcttagtgttctctggaagaaatagctggaagtccctcaggtcttctctgtagaaggtggcagtgtttattttgtatgcttattggttttgtagtcttagataaaattccaaagcaacaggaaaagccctattagacatccagttgcacttttagatttttctgccactccatgctccttagggagccagggcctcctagaagatgaagtgcaatagtgtaacttagcacctcgtttttaaaagggaaaaaatcaattgtttaactttttttctttccccccaccacctacttagctgtttaggaatgaaagtataatctttaccttctctccaccagacacttccaacacagcaagtctgtctaactatgtgttacttagaagttccagagactgaaacttgaagcaaaccaggcacatccagaattctatcccaataggagattgccaccatttacaacctcactctgcccatgatggcactagtgagacctccggatagataagaaatctgaaaagtcacatagaccctgcacttcctcgccctctcccctgcgtgcccttcactccaagccttcctttaaaagcctctgctttctgcctggaagcaaagtggcaccctgaggaaggagactgcactactgcccttcagctagctctggaataaagtcacttttctttctaccagatcttgctcttgttaattgaactccgcaagcagcaagcaactaaatctttattcagttacaatagtaagtcaacaagtaatccctcaacttcttctaaatttcagggttgaaatttgaagaaaaagtgagtcacagagaagcattaaagatagtaaaagctaacagtgtttatcaagctctctggatttttaaaaaatagcatcccaaatatattaaaattagagttcaatcactcttacagctctgtcacacttgagatgacaatgtaaagaaagtgtatgattatagtgatgaaaacagtggctgccaatttgaggggtatctactgtatgcaaggcttatagtgttgagcttgttttgaatattttacttgtaattcttgcagcaagcttgtgagggaggtataattcctccactcactgtctaggaggtaggtgacttgcccaaggccacacacttgctcaaatggcccggatgaaaatggaacccttaactgcacagctgcaaagctctagctcctgaaatccagaatcattatcaatgcataatgcaccatggcccagttgggtgttttccaggaatacactgatgaaaaatgttgaatattagaaaaactatggatgtaatgcctcatattagtaggccaaaaaataaaaatcatctgagcctctcaagagaggctaaaaagtaatttgaaaagattcagccttcattactgatcagaattcttagtaagctagaaatggaaaggcaccttcttatttccagaagaaaacgttcttatagcctcaatgcctaagagaataaacttaactgaaaaaacaagctattggaactactaaaagatttcaatgctatggtcagacacaaagcaaataaacaaaaataaatagccatatgccagtaataaccattataaaactataataaaatgtatcctattcttaaatgtaattacagtataaacacttaagtgtaagctaagaattgtgcagcatgtatatgaaaatacaaacacctacaaagttttattgaggatgagaaaacaagacctgaacaaatggccatatgtcatgttgttggattagcaaatttaatattgtgaggatagcaatccttcccaaattaattgatgggtttaatacagttctaatcaaaatcttaatgggattcattttgaaacttaaagtgatttaaaagttgatctgaaagaaaatacaggagaaagaagtcaagagcacttagaaaaagtgattggagggtttctctgtgaaatgtcaacatttgtaaaaactataataattaaagcccagaaatgaatacagtacatagcaaaactgactttaaaatttttttttgatgcatgaatgaaagtatatttttttaatttttgaaacataaaccctttcacaaaaataaataggcattcaaatatcccaaataaatttaaaagaaactcatacatatagagtgccaaccacgtgtcaggctctgggtagcactttacaagtatggaattttcataacaggtcctgtgtgattggtcttataaacaacttatgatgagatgttacataactaattttattttattttcttctttctttcagcctttattttttatttttatttttttattatactttaagttttacggtacatgtgcacaacgtgcaggtttgttacatatgtatacatgtgccatgttggtgtgctgcacccattaactcgtcatttaacattaggtatatctcctaatgctatccctccccctccccccaccccacaacaggccctggtgtgtgatgttccccctcctgtgtccatgtgttctcattgttcaattcccacctatgagtgagaacatgtggtgtttggttttttgtccttgcgagagtttgctgagaatgatgattttcagcttcatccatgtccctacaaaggacaggaactcatcattttttatggctgcatagtattccatggtgtatatgtgccacattttcttaatccagtctatcactgttggacatttgggttggttccaagtctgtgctattgtgattagtgccgcaataaacatacatgtgcatgtgtctttatagcagcatgttttataatcctttgggtatatacccagtaattggatggctgggtcaaatggtatttccagttctagatccctgaggaatcgccacactgtcttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcacatcttttggctgcataaatgtcttcttttgagaagtgtctgttcatatcctttgcccacttttgatggggttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttgtggttttagatctaacatttaagtctttaatccatcttgaattaatttttgtgtaaggcgtgtaaggaggggatccagtttcagctttctacatatggctacccggttttcccaaaaccatttattaaatagggagtcatttccccatttcttgtttttgtcaggtttgtcaaagatcagatagttgtagatatgtggcattatttctgagggctctgttctgttccactggtgacttttaaaatttatatgacactttgggaggccagggcagaaggatcacttgagcccaggagttcaagaccagcctgggcaacatagcaggaccccagctttacaaaaataaaaaatttatatgaattgaaaattgcttatcaaatagtacatgattaataaattgtacatggtaagatactttgtaaaaaatagaatttattgcatatattaccatgtgctaattaaattatgggtagtttaaaaacttaaaaggcaaaactagaaaaaaataaagaaaatatcattcttttattgggagagactctcagttcattaaaagcaagcaaatacaccattgaggtcatggtttacacattttactacatagaaagacaagaaaaagaaaaatcttctatgccatgttaactaaaatcaaaaagcaggttagtaaactggtgtgggaaaacatgtgacaaaactgagaaaagggagataaaatatctttacacataaaaagctctaactttaaaatgtaatcacattgatagaaaaaaaggctaaaggcataaagaggtaattgctaaacaaaatatgaatagcaaaaagcgtattaaaaatgtccagtgttacagatgatcaaataaatgcattttatctatcatattacctacctatatattttttaaattgttaataagcagtattggtaaggaataacaaagcaggttcttacaggcatttctgcaggtaagttaactggtacagcatgttaagaggacaatttgctaattttttttctagcaaaataatcagagctgctcaaaagagagtttcagacagagatcatcactgcattatttataaggacaaagacttggaaatcacttaaatgcaccaacgattggagagtagttaagtaaattttggtgcacacacacagtggaattctatgctagtattgttacaaactgtttttgtggtatatgtatctaatggcatgggttaatgttcatgctgtaggaagttttaaaaaaaagagcctacaaaaccacgagtgtaagtaattactgtgtcagttttgtgaaatataaatacacagaccgcatatcagctggggccagtttaccagtgaaatctatgaagtattgaccagaactccccatttcaaattctgcacatggagatttcaaaaagagcacatgagcccctgttcactgcctgccctggattctagaacatcagtcaaattcttctggctcccctaactgaaccaaatgtggacctgggcccttccacaccaccctgccgaagccacataacaaaggctgtttcctgcagcagcaaacttctcttggtgtttggtgggactcaggcaaggggtcgcattgccgtcctgcccagcatagaactcatcctttctcagactttaaaagtcctttcaacaggcaagaaattttcacctctttctgtttcctccctcccaaattgcccacaggtgcagcaaagtcttctcattcaagttcctagagcagttcaactttctctagactctatttccaggcccctctttgtacatcttttgcactgaactgaacattaagtggggttgggggagggcggctcattctgagatcaaagtgtttctttgaatggaaacaacccttcttaaaatatgtattttaacctatctgcccttgggtataggtacagagacagacatgccatatatatgtctgtatattatgtatatatattcatgtatatatataaatacacacacacatacacacacacacacacacacatatattcaggtattgagactgtgggtcacaaaaatttatataatttagaaattgttgtacccattggagtcaaatgtgaatgtgaatgattgttataaattgtaaaacactctatatgagggtatttttattacagttagtgaatcattgacatttttggacagtacagaaacagtcccaaatttgctaagccctgagatgcaaaccaagcttcaagctcagtgttcaaatagagtaagggacagttaaatagggggtttgctttcagtcccatcagagttttaatgctagattcactccttaggatgctggacagccttgggcaattgcttgacctctgtgaatcagtttccccctctgttaattagtataatgctgcttacctcactggatagaaatacaggtcattaatattaatgatggctaataatgctctgcaaggcttaccccactgactttgcctgcaaacctataaccccatgaggtaggttttatcatgaccattactaccaaggccagagagatttagtgttttgctccaagtcacacagtttaggaagtagctgaggttggggcctactgagtccgattagagtcctgctctggacccagctgaccatagaactctaagtacaatgcttagaacttagtaggtgcttagtaaattggagcctttggtactttaacacctaggggctcactttctctctcattatcaatatattacctacttatatgtttcaaactggtagtaaccagttttggcaaggaacgaagtaggctcttaacaggcatttctgcaggtgagttaactggtacaacatattaagaggacagtatgctatcttttttcagtttctctctcattacctaggccctaggccttcctcaccattaaaccccaaaaatcctcattgccatgagtctgaggggctagccctttgctgtgttcacaaagctcactctatcaagagcttggtatgcagcctcagccaaaatgatgcctgagccagaggaagccaagggcaccctgtccattgctggccattctggaacgcagaggtctccctgcagtgagaagaatgggagagttatcctgagcagtgagcccaaacctggcttggtgcagagaaaaagactctgcctgacagaaaagaggaaaaccagagtgtcagttgtttctaaatcccacccactattggcttgagccacaagtcatcctgagattcttgagatgaggtgtagcaggaggtgagagtgggagttagggggtctcgaaggtcaatgggaatccaccagagagtggttgtccatccaccacggccatgtagattttccttgatggggcttcttaatcattagaagcttgtaacttttccagccaacccttttcccacctgggcttagggcggaaaatggatgcagccactataactactctggtggtggctgccattttacttctttatcttcttcatctttatacttgaaaaaaagaggtagcacatttttgaaatttgaaagtaaccttttgaaaataggaaatgtatttcatattccaattaaatatatattttttgcttgtgtctattcccttttagtcactgacctcattctcatgtaatcatgctccatatgccctttagtctcattggtcactctacagcataaaataaatattttacagaaaagttttgtgtgaactagttaactcatcattgccctttacatgtccctttaaaagtcacttcgcaaaggaccttgttggtctagcttcctcctcctcactctccattttaaccatttaaaacactgtttacggctgggtgcggtggctcacacctgtaataccagcactttgggagtctggggcaggtggatcacaaggtcaggagttctagaccaggctggccaatatggtgaaacccgatctctactaaaatgcaaaaattagacgggcgtggtggcatgcgtctgtagtcccagctacttgggaggctgaggcaggagaatcacttaaacccaggaggcagaggttgcagtgagccgacatcatgccactgccctccagcctggacgacaaagtgagactctgtctcaagaaaaaataaaaacaaacaaacaaacaaaaaacactgtttaccaaacttaccctaattcatagttgtctacttatctgtgtgtgtatttgtttattacttgccctttccattagactatatactccccagggatcgttaccttgtctgttctggtcaccagtgcctggaatcatggatggcacctggagggatgcaataaataggtgttgcatgcatgaatgaatgttgtggagacaaatgtgtgcactggagaaaagttggaaaatcataaaaatatacacacaacaatgaaaagaatccaacaaagcatcactcagtgataacaactgttaccaagttggcttttttaatggtttcatgtcttatatttagctcattaactaatagagggtttgttttggtctttggtataaagggaagtttcaactttgtttttcagtatttaacctattattccagcaccgttgctggaataagcttacaataccccaaacagtgatggactggggagggagagtatgggagtttcttgggagggagaagggatggaagcttagagcctgacccaaagaagcttcacagctgtaagagaacctatcagagtgggtgccatatttacaaatcttctgaacttgtagacataatggtggagcagacaccctgttagggaaatttattttgggaggaaagctccagccccttccacgtggccagcaccacctgctcttgcatagcctttacagtacaatcttcctagagccctttataagcacaatttctattggtcctcacagtttccctgcgacttaattcagatgatcactgtcattttacacagggacactgaggctctgaggagtaaagtaattttccccaaatctcaaatctcgtaatagctgtgaaatagcatctcctgaccccagactcacctgactcctgccgtctgttcactacagaaggtttctatgtgctgtgaatcttggattaaccagacagcatgggggaaaggtggtggcgatgggatggaggaggcaagagctctgattaattgaattttttttatttgaaggttaagcagcgaatccatttaaacttgacccacactattttatataggactgtatatgaactaaacacaataaaattgagcccagaggaatatcccttagaaggaagaagtcaataacataacccttaattaccttttatagttggtacatggatttgactttccccgcacccaccccaaagcatttgaccaaagccatggcagcttagacatctaaagacctcccacaggctgggaaagaccatcccactgtcttgaatagattagactctaactccctgaggacagacctctgtgtctggctggcgcatctggtagtttgaagagtggatgagtgtacattcttaattaggtgtggctatcaaggtaacggtattctgtattatgggagtttagggttcagactgagtgtgcagtgggatgcctgtaatatgtcacacaaaatatcccaagaccatgacatttaattctggccacatattccaaagatagatgaaagatattacctaggagagcaccaggccctatggggatgagctattaaagctgtcatatgagcaggctggaggtgctgacccagatgttttttttgagagttagagagttcctggtgcctggagctgttcaaacttctgctgtatatagtggaaaagttaaggcaggtattcacgtcttaatggcatttcgtagcaatgatgaaaaaaatatgttttcattattttattttggaagatacagaaaaacactaaaaaaggatgtaaaaagaaaccatgaaccccaccacatggagattatacaaaattttgagacatttctttccattagggtttacttttcttaatacagacagatatatctccctggacaaaactgagctaatatgtaaatgttgttgagtaacacactttaaaacaatgtataatgaatatttttctatgtactcaagtacctttttacttcaataaatgcaaatattaaattgaataatatataatagaattgaatagatatggtcttagtttttatggatcctgaatactaatgggggagacatacattacatttaatatagatacagaaatacagttttcattatttgcagatttcatatttgcaagtttatctactcactaaaatttatttgtaacaccaacatcagtactcttggttctctcccagtcattcacagacctgcacggaacagtgaaaacttttggttgcccagtgcacatattactagctggggtcagaggtagcactctgccttcttgtttcagctcccctactgtaaacgagtgtgcttttcatggtttatttagtgttatgtttttcacatttttgtgctgttggtgattttgctgctttaagtggcccccaagtgtagtgctgaagtgtcatctgatgttcctaagcgcaagaaggctgtgatgtgctttgcagagaaaataggtatattaaatgagctttgttcaggcctgagttacagggctgctggctgtcagttcaatgttaatgaattgacaaaatctgttaagtaagctgtctttaaacagaaacacacagaacaaggttatgtacataaacaaggttctatattaatcatttgacaaaagcattgtgagcagaggctcacaggaactgaactttgtatttctcctaggagccatgggttcaatattcagtaattcagtgcaactttagagaacattacttccaataagaagaatcagttagatatatgtacaagtcagtgatagagacatacatttgggttctttggctctagatataacttaaaactgttaaaagataattttcaagaaaaggtaaaatcaaggtacttttcttaagaaaaggtaaaaaaaaaaaaaaggtaaacctcacagagatgtaaaaatgaacatgattgcatttaattcattaatgaagaaactggtgaggtgttacagccagtacagaggaaaattcaaaggtaagagatctgtatacttcaggaatatgcaaatggaagcaaaactagctttttttccttgagggagcaaggttgtccctcttcctgatcatggaaccatttgcatatctatggacaagaattattctgcattattatcagttatctacaatttccagagttgggaaacagctcccatagaatcagaatctgataacaaggaagcatgagctataaacaatgcagtttttcattgaagcacagatttttcccccccacaaagccatactaataaatgccatcaacctagataaagcatgtggagagacaagagaggccaatcccagggaatgccaccaccataaggttgggttgtgaagaaagagcctgaaaagaagaccatgaacgaacaactaaaagcaggaggaaaacaaggaagttgtgatgccctcaggtcaacagcaaaactgaggatggagaaagtagccaactctgaaggattgagtaagaggtgctccaaagggtccccttggtgtattagtccgtcctcacactactataaagaactaccagacagtgggcaatttgtaaaggaaagaggtttaattgactccctgttccacagggcttaggaggcctcaggaaacctacaataatggtgggacaggaagtaaatacatcctttttcacatggtggcaggaagtagaagtgtggagcaaagggggaaaacccttataaaaccatcagatctcatgagaaatcactcaccatcacaagaacaggatgggggcaaccactcccatgattcaattacctccacctggtcccaccctcgacacatggggattatgggaactacaattcaagatgatatttgggtggggacacagccaaaccatatcacttggatttgtcagtgttggagtgatgggtgacttggcattaacagatattaaaaatataagcaggcaaaagccagtgtcatatgataggtgaaaagggggtgagagagtggaggcattgttttgattacagtcttaatatactgttatatagatgtacaattgatttcatcctaactttgatttccagacatgtaagtttttcctaatttttaaaagctgtaatcagcatcctgaaagatactaatatatgtgcacatatgtaatattttttcctggaataaattcctggaaccgtccttgctgggtcagtgagcattttcaagactttgagacagttcttcaaaaattgggtcagttttcaccctgccttcaacagtggatgagcagctttgtttatttggacatgcccatctatagctattatgagttgacattctgcctttattcttctctgttttcctgagacaataactctgcaaacaagtggtttggtgtttggagctgataatcaatggcttttatttcttatcactacttgtaagtctcaaccccctatttggagcggaatccattctctcccttactggcgttaacacatgtcaaatatttgcaggctcttatctttcctttaggcttggcttaggcaggctctgaatttttagcacctgacattttctctcccacatccatccctctattttccttagggctttcctatcttgcctcagcttttctccctcttaaggaagaaaaggccatgcctccatacctaagaacaatcccatctaccagggtcaatagggagattttccacctttacctccctgtgagctgcatgtcagctttatttttaaaataaaagctctatccagctcatgtgcattgagaacttgcttcaaggatcatatgtccactgtttctcatctctgatttctgcacttgatggtatttcttagggctgtgtcctctgcccaattctctcttcattacacaaactcttcctagatgtcttacctgttccatgacttcaacaagacatgaatatatccccacttctgaacttcaagtccttatgcctgactacttttcctacctgttttctacctacctcaacattataggttgatgctgaaaatggtctactcctatttggtaaatagctactccaatttggtaaacatcatcctgtttgcccagatcagaaaaacctgagagtcatttggaatccacccctcaccatccttagcctttacacccaatcagccatactactgtgcatgttccctccttatcctttagatctgtttcttttttctccagttttactctcccattcacagatgtggcctgaggagtctttgctgccactattcattgaagtctcatgttttattttacacccataaccaaggtataaatatgagatctggtaaatttctttttttcttaaaaagatggagtcttgctctgtcacccaggctggagtgcagtggtgcaatctcggctcactgcaatctctgcctcccagtttcaagtgattctcctgcctcagcctcccaagtagctgagattacaggggtgcactaccatgcccggccagtttttgtatttttaatagagacaaggtttcaccatgtttggccaggctggtctccaactcctgaactcaagtgatccacctgccttggcctcccaatgtgctgggattacaggcgtgagccactgcacccagctgagatctggcaaatttctaaggcagattattactattttttcttttccagtagatgatgatgtatttttaaatgtgatttaattttgctacttccatacctttccatttttggtccattgaaatggaccttttcagggtggaaggggtattacatgtctcattgctgataggatcaaatacaccatgatatgattggatccattgaattgtcattgctgaagaaggtctcgtgatgactaaatgggaaagtgaatttaaatgcatataacattaatgcaataagatataatctataaatttctcttcaatgcgggtagtagtgatattcttgccctgatgttagtgggctttgggaagccacaggatattccaaggagagtatgaccttccagatttaaactctcatctcactacttaccagctgtgtgaacctgagcaacttactaaacttctctgggctaattccttatctatacatttggaataactgtacccatctcagtgggctcctgtgaggctttaatgaacagatatgtagagagtcattcaaggtgcccagaacatgataggtacacaggaaaaatagttatccagcaaagctggtattgtctggatgtgttggacgtagtgcagtctgcaaagagataactctttcgcttgtccctacccctctctgtagtaaccatccgcttgaatagtttcgtgccctcaatgagtgggttctgggggtagagtggccctggatgtctggtgtgggatgttctcatttgtggccagttgctacttccttgttccactgcagctttttgagaggtcctccctaagttgcctgcctgcctgcctgtctgggacagtgttttttgttttttgttttttgttttcttcatccttgaatgcactgtgctagggagagccttcttgcatcattcttggacctttctaccagccttctcctcctgggtgctaattaccaacttcatgtccttgctgctgttcattctctatgggacagcaatggggagcatcccaacaccaaacctagcctgatttctccctcagtttacatagtttccatggcctctaacatcctgggagtgttgtcactacctttcctgccatttgaagccctgcaagagcttctccagcctcccctgtcctgtcctgctccctttctgcgccctttttccttattttactttgtggtcaggagatttcaggacttatggaaatgttttacggcctggaaaagcaatatgttgactcaaaaatgtaaaaagaatactgaataattgaagctaacaagaattcgttatctatgacatatgtgtctacatgcctttatagatattgtcaaatttactgttcaaaaaatttcattacacttaacgataaactgtgggttagttttcctcgcagatcaagaattcccaaaggaacaaagtgattagagaaaccacagacagtgataaattattaagttcttggaaaccaagtgatgttgaaaatgaaactattttttaaatagttcaaaataattttatgacaaaaatattccagttactctcaaaggtagaatgcaggtgtatcttaatacgctgtcagggagaattccacaactagactggcctgtgaagatcagacacatctgtgggcttctccttgacctccagccttccactccttagctgcctgctgccatgaatttgcacctgatgattgcaagatcatctacctttttctttttattatcactcaattctgtgatacttgatgctgtccttgataggctgtaagccatacaagactgaaggtgtgtgtattagtctgttctcatgctgctaataaagacatacccaagactaggtaatttataaagaaaagaggttgaattgactcacagttttgcaggacttaggaggcctcaggaaacttacaagcatggaaggggaagcaaacatgtccttcttcacatggtggcagcaaggagaagtgtagggcaagtgggggaaaagccccttataaaaccatcagatttcatgagaactcactaccatgagaacagcagcatgggggtaaccgcctctatggttcaataacctcccactgggtccctcccacgacatgtgagtactatgggaactacagttcaagatgagatttggttggggacatagccaaatcatatcagtctgttagtcttatttatctgctgggttcccagtacagagcacaggacttcacacatgatgtaggctgtcagtgctattaactggtagagcactggtcagtcctggaaagttatgatggagaaagagaatgctgggaaatttgccttttatgaggtccttagggttaggtctgagtgttgccagatccattctgattattctaccacatgcacctcatatgaactgaaggacacactgttcaggaaatctgcactaagtgatgtgacacaaagatgggggaggtgacacaaaggcagggactcacccttggcaaccatcaggcccttgatttggcctgctatcagaggcaccataggcatcaatgtcttcagtagcctcccagcagcaaagaaaggaatgtgatgagtaggattggttctgacagcacagattggagtttctaggagctctgggactcatgagtgaaggggagggggatgctctgagagggaaacaggaaatcagcaaccagtggcagaaagaatccagagagccacagcaatcataaccagatgcaggctggaaagttacaacaccctgcttcgtgcaccatccctcagcacattcctcagggtagtgatcacagtgtcttctaagctctggtacctcagtgcccagcatggtccagcattgagcaagtaagtactcaaggaggttctgttaaatgaatgaagggctacgtggtctaagcatgcaaatggcaatgtggattcagagcagataattccccttaaaggaatctctccaagtatcctgatttcataatgaatgtttaatagaccattttttttgtcatttgaatagaatagaaacaatatgtggcaggcattttacctacattctctacttattaatagcaattgaagatatagtatcatccatcttcctttttttttttgttttttttgtttgtttttgtttttgtttttttgaggtggagtctcgctctgttgcccaggctggagtgcagtggcaccatctcggctcactgcaacctccacctcccgggttcaagcaattctcatgcctcagcctcctgagtagctgggattgcaggcacacaccaccaagcccagctaattttttttagttttagtaaagatggggttttaccattttggccaggctgatcttgaactcctgacctcagatgatccacccacctcagcctcccaaagtgctgggattataggcatgagccactgtgcctggccatattatcccttttttaaggatgagggtgaagcttggagaaggaagtcacttgtccatggtcacagagctaatgagtggcacacccaaactttgaacctagatgaagcttccagtgtctctgctcagcaatacaacctgccttgaatatcattagtaatgttctagaaaaggcaactgctcaaggcacagaaacctcactgggcttgtaatcacagcaagtggattccagacctgcccctgcctctgtcccttaatgactgttgcttaatctctttgagcctcagctttctcatctgtaaaatgggaacaaaatatgactagctcatagatttgaaacagtcactaaatggaaaacatttgagaaaatatccatgacagttgttggtaagtagaagttaaacaaatgtccattgattctgacatttgagatcaatagggtatgcctatattttcttatatctgactttgacaagcaataggggtttggccatgtttgttaattcctatttattctagtttaatatatgtccgttgtcacattcaataccatcatttttagactttccatctgtaaaggcatttatctttttctctcacaataatatataccaaattcactttcctttatcaaaatgctttttgtttatagaaccctttataatctgacaccattcagatataagagccatttaattacacgtgtaaaataaactaaaggctactttattcactcacccatttgaaaagtgagtgaataaagtagcctttagtttattttgggggcctctctggagagcttcgccagagaaatggaggtctatgcacttcctcaagaattcaggtattgctggggtttcttaattgtgttcttttctcactgtgaacacataagatccaattgcatttgcctggccgttgtcattctttgacacactggcagagatgagtattttctccactgtggttgttttcctgagaacttaaaaatataggaaggaaattgctttttctcttctactttatctttgcataagtattcttgggcatctcagagcagcttaggagatgacctctgctttattgtccctgcagagccaagacagaaatgcaagcagcagagaataaaagcacttttcttgtgcatgctgagtctttcaacaaccctggcctctgtgactgtgtctgcctgtaactgtcaaggtgatgattgaaatgaatctgctggtcaattccagtttagtccaatccctgatttgaaaaggccccctctactgcagctgattgagcaattgtttttcatgattgatggaggtgacagatttattttagaaaatgaggtgatcctgatgagcccagggagatggaggagggcatatgtatgtgtgtgagattgcttgagggagggaggatactgccttgttaatagcatctggcagtgatttgtgcagaaacctcagtggtgcagaaggtcagttaaggaagtagtggacagggtattggaggttggttgggaaaacctggatttcaagtcctggttctgctgtttacttggacaagtttcttaatcattctgtgcttcatcacctgtaaaaaaggagccaagtggaagagactgctaaccaatatctgtttgtaccttcttacttcctgagatgggattatttttttctggcaatgatgtgagtgctaaaagactatgcccctcttgcagctgagtgtggtcatgtgaccaagtgttagccagtgagatgtaaagcagagtggtggagggtggggccttttggagagctctttataaggggaccacagttggagcaggctcttactgccctccttgtcttccccttgcctggataacatagacctgaggcaagtaagccttgcctgcatccaggagctaaggcaaggctctgattggctctgtgctgcagatgcttgagtgctatgcaaatgcaaagaggttctcttgttaactgcacctgggttgtctctccaaacatgagagagaagttgagggagggatatgtctgctctcaaccagcaaacactttttgcagtaaatcaagcataacttaggggctctttcaggaccttcccatactccccagagatgagggagttattactttaaccagcattcatatctttttctctgtgaggaatctatggatacgtttatagagatggactttcaccacataaatgtgtgcctccatgaacttggcttataggatgtggtgagaacatggagtgtatgattctgaaatcagactgccccagttataggtgagcaaagagagagatgagtgttctgcatggccatcaaggcatgtgatatggtttggctgtgtccccacccaaatctcatcttgaattgtagctcccacaattcccacgtgtcatgggagggatccagtgagaggtaattgaatcgtgggggcaggtctttcctttgctgttctcatgatagtgaataagcctcacgagatctgatggttttataaaaaggagttcctttgcacaagctctccctctttgcctgtcgccatccatgtaagatgtaacttgctcctccttgccttctgacataattgtgaggcctccccagccacgtggaactgtgagtccattaaacctctttccttggccgggcacagtggctcaggcctgtaatcctagcactttgggaggccgaggtgggcggatcacaaggtcatgagattgagaccatcctggctaacacagtgaaaccccatctctactaaaaaatagaaaaaattagccaggcatggtggcaggtgcctgtagtcccagctactcgggaggctgaggcaggagaatggcatgaacccgggaggcagagcttgcagtgagctgagattacaccactgcactccagcctgggcgacagagccagactctgtcaaaaaaaaaaaaaaaaaacaacgacaccaaaaaaaaaaatcccctttcctttagaaattacccactcttaggtatgtctttatcagtaacatgagaatggactgatacaggatgtgcccacctgcagggctgtggcctggcctccctccaagaagcatgatttacatagccttccacatgaatggtacaccttggagtcgaagagtacagtggcgctagacacgcaggggcctcagcacaggcatggaattgcagctgtagcggccttcttgggctgtgttttagtcacattcgggggcctagggcaactcttcatgtgggcagcttctcacttaatgatagaacctgctgtttctcttctgaaccttagcagctgccttccgattatctgtgtagtgattcaacacattccttgagagcatcaggctgctgaggccaactgtgttcctgtgatggcttctctctctgccgggcttggtttgctgggaggacagcagtagtcttgcagagctgagagggggatgtagagtaaggacaaagcaccccaacagccctttttgctgttaatgaagcatgttcgtgaaggaccccttgattgaagtgatggaggagtctgttcttcttgagccattttttccttggatgcatttgtcttcaatatgacagccaataacccagtaaattaaacagcatgccccaaggcccagggtctttagaagagctctgtaaaaaccccagacaacctcaggggagccgtttccccagaggatcaggggaaagtgttttcacctaaagtctaaggaaagacccacttcagggccatttctaagctgctatctccaaagtgtccttggttgccatcttgagtagggacgagaaatttccagcaaagcttacctcagagaagaaactcctgactttgttattacttaatgatttctcttaaccctgactgctgtagattcgacttgcagcatcttatgataaaagaagaagtcaggataaccagactgttcttttagttctgaaatctgagaggaacaggctactagagccttggtttaatgagcgtcagccggtatcacagacgctgtccctgttagcgggtttctgaagatgcagacacatcctccagccttgtgtctcccatgactcctttcacaagcgctgagggtggaatgctcaagtgcagagtctgtggaggtgaggtcatagggctgagagtggagacctaggtgtggaacttcctgaggatcaggctgattttacagcagagactcaggggaacttgcaaattggatggtttcatctattagctgtcacagctggacttccgggtaaagtgaatgtctgagaaattgaacctgaaacgtgcagtgggaatggattaagaggagctctgggctgttgacgggacaccaggggtacagcatatgaggggaccatttatttactttatttattcatgtattatttactgaatgctgctctgtgacagacactgtagtggagactggagatttagaggtgaacctggcatcctcccctgtgtcttagtagcccacactctcatcacaagaatggcaaagatatgaacctggggatgcaatacaagcatatcataactatcttagtcattggaggctgggcatggtggttcacacctgtaatcccaacacattggaggccagggtgggaggggtcacttgagcccaggagttggagaccagccctgacaacatagtgagaccccatctctacaaaacaatttttaaaaagtagctggccatggtaacacaccctgtagtcccagctactcaggaggctgaagtggaaggattgctcgagcccagtagattaaggctgcagtgaaccacgttcacgccactgcactgcagcctgagcgacagagcaaactccatctcaaaaaaaaaaaaaaaaaaaaaaaaaaaaaaaggctgtcttaggttgggatctctagatatagagcctgagataggagaacaggtacatgtgatttattgagggaggaacctgttgaggagggagggatgtgggtggggttgagtcagaatgtggtcaggttaagtatccccttagttttacccagaagctgaagcctatagtgcagcaccatccaacagaacttcctgtgaagatggcagtgttctgtatctgggctgataggagagtcaccagcgactcatggctactgagtactcaaaatgtaatttttggagttgaagaactgaaatattaattttatttaattttaatgaatttaaattgaaatatccacatatggccaatggctaccatattggaagtgcagctctagggctcggtggacaagtttcttccatcaagggccagagtaaatactttagatcttgtggcccagacgacctctgttgcaataactcaacttctgttgtagcaggaaagcagccatggacaattcaaaaaggaatggggtggctgtgttccaataacaatttacaaaagcaaatggagagctggatttggtccatggtccataaagcacactgaagagttgccccttccacatacattctgccaggggccagccttgcatagcctatgccagtttgcccttggccgtgggtcccctggagaagaatggtagtttctgggcaaagtgacacctaccagttgagggcattgcctggagcaagggaagggtgggtgggatgctgtgattcctgggcacctgacctcacagcaatggggatgggtatagtggctgggtaaggagaatctaggaggtacactacagtgtctactacaataatcaacaattctttttgtgtgttcactacaagccaggaagagtggtaggtgcttcacatggattcttttcattcagttatcaaaatagacctattgagaaagtaattgaagcatctccagcacatttctataaaactcactgagtttcatcacttcagttttgttggcttgtaaccaatgaccaagatatttattctgcctctctctctctgtcacccctccctacacacacacacacacacacacacacacacacacacacataaatacacatcccatctgaaacatacatatggtgctagtggcagtcatgtccttttttcctctgggtggctttcctctattcccagagacctccgtgacctgatctatctttgttgtagccgcctgtacttactctgactctccgtggtattttacagcccatatttccttcttcataggaaacccatctctccatgtgttatgttgggttccctcaaaaacagatcctgatttgggtgtaagtcatttccttcggaggtgatccctgaaaacacagtgaaggctcagggaagggaataaagaccaatgaagggtgtgttaatgggcaggttaccattgtggccaactgtggttcatccccactggaggccctgctggacacacatataccttagaaagttagggtatttatccacccattcccagccgacattggatgagggtcgctcatggagtgttaacttcctaactcttccacacgacccagagttgagcacattccctcagggagagccccttcccctccattcagggagactcaaaaagcaggctgcctgtgacctccaggctgcaggtagggttttgtcagcctttgtcacactcctctgtcttgacttactagtagttctccaaacatggacttttctgacttagggatctatagccaaattctacagtgccatagactgcgtgacaaattgcactgtgaaggagaagttacagacttactaacttggggtgagaaaataaggaaaccacttcatgagccttggcttgtacttctgattgatgtagcaaggttctgaacttctctaggtctcagtttcttcctctgtataatgggagtgatggcaaggcttttactgtaccttcaatgagaaatggaagagcacatacttagtaatctgtgcaatacatatgaatataagttattgcttaaggactaagtgttgtgattaaggcaatgtaaatgaattgctgatcattatcccaggtctttaccttaatgtgtatgaatctggagctccttactcacagcctacctcccagaaagtccctgagtgctcctggggccaggctctggggttacactgaagaccactttgctgagtctctggactttgagggctcatgaccagagatgaggaagacccagggtcattaccctccatgcaaaacaccttattcttcattgcatcctatagcccctgtcccctgtatctgtgcccaaatacaagatgcacaggtaagagcctaacctagtgatgaagagcatattgataagagaaggggcatgaacatagacaaaggaaagccctgtactctgctttggaaacatgaagatcagtgcccaagacctggaaggctgtactgataaattgggaggggacttggatgatgttttcaggtatttcatctcagggacacattgcagagctttaagcagagagtgacatgtgttttgggaagtctctctggtttggagtgtaaggcggattagaaaaggtgagtctggaggctgcaggccctaagaggaggctgtcacaaaggtccaggtgacagagacaatgaggcctggatgagaacagggctgtaaacctgcacagcctgttgaaggctcagttgcagattgggattcttgggactttactgagaagtggcaagagtgcagttagggcccccttggttttctgcgggtctcttcaggcacatcacacagcctggattttaagagcactgcatcatgaagagcacttcactccttcaatctgtggatcttgtgtttgctagaaggctttctttcctgatggtgttctctcttcccagagcaccttgtcaaagaaggagaaggagccataagctcagagaggaaggcagccagctcttgattcatgatgcctggcctggctgaaaagggaggtccatagaggcattatgctcaggcaaggggagggttgcaaccagtcgtataaagcagcttggtatgaggagctctcttatagtgtgcacaaagcaatgcatagtggttgtggcggaggctctgaagctgagctgcccagcttgaaatgcttgcccatcactaactgtaagcttgggtaaggtatttaaatttttgcaccttatattttcatcttgaaagtgaaggtagctgggcatggtggctcacacctgtgatcccagtgctttaggaggccaagttgggaggattgcttgagcccaggagcttgagaccagcatgggcaacgtagcaaaaccttgtctcaattaaaaaaaaatagctgagtgtggaggcatgtacctgtagtcctagctactcaggaggctgaggacaggagaatcacttgaacctgggaggttgaggctgcagtgagctgtgattgcaccactgcactccagcctaggtgacagaacaagaccctctctcaaaaaataaataaataaaataaagtaagggtaataacagcatgtacctcatgggtttttgtataaggaataaatgatacaatccatgtagaattttggcaaaatgcttattcaccaggtgttatcagcatgtatgaagaaaatagtatgtgtgaagtaatggaactggttgcatcagtcagctattgccataataatgctgcgtaacaatactcaatgtgcatcttggattaactagcaggtcagctggaactagatggtctcaggtggcttcagctgggtgactccactttggtccacctggtctgacattcaataagctagcctggccttggggtgtcttctcgtggaagaagtagggatccaagagaagaagcagaaatgcacaagcactttttcaagcatccacttgcccacagtttgctgttgtcccattggccaaaacaagtcatgtggccaagcccagagtcaaagtgggaggaaactacccaattacaagtcaaatacagatccaaggagagcactaaatgtattcattaacacaatcaatatcactttggttttttacattaacctcccaaagtggggttaatccttgaggcaatactcatttcaacaatcctgctctcccactaactaattaggttattcttccttgggaattattggtattaaagagtgtaatactagttaccactcactgggtacctcattgatctcaggtatttaatgttcctacctccggaggctgttatgaggattaggtgggataatgtacatacagtccttagtttagctcagagtgagcacattgtattaactctacagattcacattattattcacattattatcattgttgtcaccatcaagattattactattccctatcttactccaaatgtaggcatttttatctccatttaacaaataagtcactgagactcagggaggtccataactctgtcaacgtcccacaactagtaaggatcagagctttctcagtcagttggaaaataacttggaaatagttggaagtcattcatatagtgtgatgtgaaagaatgatcattaatatgcagaaaatctaattctgagcccacacccaaggccctctagctttggcccaataacctgaactgctctgaagggtttccaggagtgtgtgaatcctcttcttagtggcagccttgcagaaacagaccatttggcactcacttgtctccccaggctgaattcccagacatattcaatattatctggacaggcacactgctggtgtaaacagtctggttgctgagttggatttaataaccttgtagttccctgcatctttcaaagcaagctctatgctctcccatctcagctccatgttagcctgtgagacaggtatctgggtcctcttggaagagggcactctaagacgcttagaagtcagtatgaggctgcatagtcaagatagagctgggactggaaactgggacttcaggctccaagcattgctccctctgtcgacaccaggtcttgcctgggcatggaggtatcatatcatgcctctctagcctttgccttgcctctctttaccactcttggtctctgtggctgcttattccaactgcttaggttcttttccagggaatatcagtcataaatggctcatccaagccatttgcaagttctctgggtccactggaaagaattacattcagccttaatctggctcccagtgatggcaaagcatactcacagtgtttgtgtggatcacagacttagagggacttttccaaagtctgtaggctttggtttacagaaaagctgatgcctgacctatgatagagaccctcattaatgactctgtaaatgattttcaggcgagggagcgaggagacagagagaatgtataaagcccccatcaaagacaattcttgcagacctataattcttcaatatatcctatactctcagctctcactgctgcttattcatccagggttccaggctgttctcagtgcacactttatcagttcatgcaattacccttaggaaggcctctcacacatcgctagtgacagattagcacagtccttttggaaggaataggaaatgtgtatgaaaggtcttaaaaatggctcatgctctttaaaccagcaatcaatgctggagaaattatcctaaagaattaattcaaacctaggaaaatgctatatgcagggcaatttatggtagcaaaaattggaagcaacctaaattcccaacactatggtaatggcttagtaaatcatgaccatccacttagtggaatattatgcagcaattaaaatggtaattatagatgctattgggcaaccttaaacatgcttatgatataatgctaaataaataagccaggagacaccattgaacatacacaatgattaaaatcatgtaaaaatatgtgtttgtgttgtcattaatggtggggcccgaggaacaatccacatttcaaattcccagatggagtaagggtggtttccagctagaaagcaaaatctgactgacacagaggcagcccaggcaagctgaatggtgatcctcaatgtagatttaagtcttccactaatttcaaacatctctagacatttttttcccaatgcttattttcaatacttgtgttgattagagaagattctcgctgggtggcatggcaggtaatcctagcactttgggaggctgaggcggtggtcaggagttcgagaccagcctggccaacatggtgaaaacctatctctgctaaaaataaaaaaattagctgggcatggtaatgcacacctctaatcccagctactcgggaacctgaggcacgagaatcacttgaatccaaaggttgcagtgagccaagatcatgccacttccatccagcctgggcgacaaagcaagacactgtctcaaaaaaattttttttttttaaagaagtctctatacttaaagattggtgcccagtgaatgaagttcccagtgaatggtaactagtgttacactctttataccaaacaatgtgactaaaatgtaagcaaaaatgtatagacaaagaatagattcatataactaccaataaaaaaataaattttactggtgcttatgaaatctctaatattctaatgtgtgggatttacacttcacgttggttcaagtaacacaaggtgcaacatgcccatttgattaagaacttgttagacttggtgagggcaggtacagaggtgtggtatgggcagaaaccagattgtagcaggtaaagaatgaactccatctgtgtagacaacacttttatgatgtttggctgtcaaaaggagatatcatataggtccatagctgctgacagatggcaggttaaaattcccagcttcattcgggttggggggagagggattttctggttattttgtaaagcagaagcggcgtagacaatttgaaatgctgacggaccatggccagagtaaaaagacaggtgcctggaaagaatggagtaagattaccaggaaggtagaagagagggatctaattaatgtctagataatttgtaaacactgaattataatacctaaaagagcatgtgaaatcttttgattggtttgtgtctcctagtgtcctgaaatttaggagcaatataacagacagggacatcaagaagagaaaaagtgggaaagcttggaaagcccagaagactgtgggctaaggaggagactttagggaaagttctctgggtgctttttagtgaaatgctgtaggctgtgctaggggaatgtaccctcctgtgtcccctacaaaatgattcgtgaaaggaatatgcttccttagagttgagacccaaggaatgctctgggaattgcggagagagcggattcagggccagaacagaggctgcatgcaaaggcagtggatggccagggcataggagactcagggctctggtttcaaattcaagtttcttactttaccacgaggaaaacagggaatgaggaagtgcattcgtcagctaaaatgggtgataagacagaacagaggcccaaagttacaattaaagcaagtgactaccagtgttccttgttctattatttcttagcttatttaaaaaaaaatgtaaatgccactgtcaggctgctacagagcacctgtgagtgggtaaaattgtattgtgactaaaataggctccttgtagaagaggtcaagtgtgcatttgggcctttttctgagctggttcagatttaaaggtcaacttgtccttctattggagacattaataacttaaagaaacaaatgggaaggttctttaaaatttatgtttgagttacaaaaatctatctgaaaccttataattaatgtgctatagcaatctctgttgcaagagattttttttctagtgtttgtttaaatatgtggtatttaaattggctctgccattttaattctccattaattcatgggtttatcttagacatctttctaatgtgtgggaaaacagtttataaacagagaagaaaattgaaattcaacctatatattatggattttttaattgcagaaacaatgtgactaaaatttaagcaaaaatgtttagacaaagaatagatttgtacaactaccaacaaaaaaataaagaaattttactggttcggtgcttattccattctgtcacttgtggcttgagtatgtatttgatttacttgtgctcaaacttgggtttgtactattttatatcctgcttttaaaaaagcacagcatagtcaggattcatttagtcataagtaagacagagggagattttatggacttgtgtaactgaaaatccattgttgggcccaactttagacttgaataatatgagtcatatattctatccatagactcaagattaggatcagtttccccataatacatgtagagcaggagcgaagggtgagtatcttcaaaagcacacatccccatgtccacctgttttatgtttcgaccgctcaggcagggcaaagtagatgttcagccccgctaaatggacatcctgaagtaagatttagataagcttcccagtctatcccaatctgttatactgagatgtcccattttccctcctttaattggcaacaaacctgtctcacctctggtctgggtgacaggtacatgggtgaggctatcaaactgagtaatggaatgtgtttatctatggatagaatcagtagtgtgctgataaaaataagccttgaattgtaatgtttgccaatttcctgggtgtaaatattcctactgtgactgatttctccctatcagtgtaaagttattgaatattgggttgggaagagatgtgcacaattggctcctgtgagtagatacaattcacccttctttatgtataacagaaattctctcatatagtgtacattcttatttatagagtgttttcatagatgcaagtttgatttttaaatctcagacctttaccctcttagctttgtcagtttggaggctggctaatatatttgcagttgctctttcttaaaattatttattcaatcaattattcatccttttctttaacaaatttgtattgaatgcctactgtgtgtcagatactttcttatgcactgggaactcagcagtgaatcaaaccaagtccctgttcttagaggagctgacaatcggtaaataaatattattcttcaggtgaaaatgatatgaaaaattttcagggaagggacagacagtaatgaaaggggaactgtggagaagagcgattttaagtaggatggttatggaaagcttctctgcacaaagaactgaatgaagtgagatagcaagccctttgaagatctgcaggaaccccattctgggttgagggagcaagcagcaattgcaaaggatgtgaggggggaacaagcttggcatatgtaaggatcagcaaggaggacaatgagccttgagtggtgctagcaacaaggagactggcaggagatgatgtcagaaagattgttaaggcccagatcacatagatccttgctggcaatggttaggactttggatttttagcccagtgagaaggagacagtggtgaaccattctggcttctaagtgaaacacgtagaccagtaattctcaaagcatagttccctgaccagcagtgtcagaataacctgagaacttgttgaaaatgcaaattattaggtcctcacttaaacctatggaatcagaaactctgggggtggcatccagcaatctaaatcttaggaaaccctcttggtgatgctgatgcatgatagacttggagacctcgactatggctgtgtgctctctctcctcattgtatccctccagagtcagaggcaccatcttccatgaaggtttgagtgctatatttcatcatatatatcaacactgttaggttcctgtaagaatatgatagaatccctacagttgatactttcaaaagccatcagatccacacatgctggaacttgcacatctcaccatcacttccatccttcatctccattttattttaattaattgattaattaattaattatttttgagttggagtctcactctgtcacccaggctggagtgcagtggtgtgatctcggctcactgcaacctccacctcctgaattcaagcaattctcctgcctcagcctcctgagtagctaagattacaagcatgcgtcaccatgcccagctaatttttgtatttttagtagagacagtgttttaccgtgttggccaggctggtctcaaactcctgatctcaagtgatgcccccacctcagcctccaaagtgttgggattacaggtgtgagccactgcatctggcccatctccattttaagatcctcccaatggcattcttaaagccattggtgattatatcacactcttcaccaaaggtttgcttctcccttgaacagttttatgaagtatatcctcattttggtaattttattttgtaaaatgattctatctgtttgaagtatagcaggaagagcagtttgcaacacagcatgaaggttatttaacttgtatgtaacgggtgtgaattgttccatgatactaagtttaaattattaagtatggctcagtccctacccacttcagacttttgccctcccttgaaactgtaaaagaatgccagggcttgggcaacctccatgcagccataataaacaacccttccccaggatttctggattgttttaccatgtataagagtaatcaagttcgaggttactgtagcctaatattattcaaattgtcggtcaactctattaatttcataagtacaattttttagaaatatattcagcattaactcggtgactttccttaaaagccaaagaaagagtcctcacagtctagtagttaataattagttcttatgagttatatataactacactgtatgcaagtccttaagattccaatgtggacactcagcttgcagaattcttggtgacgatatcaagctggcagtttacagatactattcagcaggtgttttgaactccatctggatctcgttctaccaactagacctagaattccattagctgaaagttggatttttacttggtcttaaaacaaaaaataaaataaaatctaaggcttcaaaaaagagatgccacaaactgtatgtgtaattcagattctagcatttccaaatatgagaattattaccatggtatttgttcaaatgtaatcatctgagcatattactacacatatctgtgactcctattacaagcagttttagcaacaaaaataataacaatttttcaaggattataagttcatgtaattgcacatgggagaaaaatatggatgttaaagcctcttaaatgtggaaatgcagcacattgttgcctattatatttttcaggttcttgttcacgaatttcatcttaacctatattcttttttttcttcaattttgcccttttgtgcatagatttcaggaatataattaaccattgcatggaatttaaaatatttcttgatactggagttctctttgctatcaagtggttatttcaaattttatttacatagttattatttttcatctggggacacattcatttgttttcaatgtagttctaagtgtgactttccaaagtttatcatccatccattcatactgatttaaaataaaattaacttgttatgaaacctctcagaccaagaggatgcttgcctttctgaaaaatattttttttcagtatttctccatctagtgttcaaattagctctgagaaaccacaagcaagattaaaggtaattgactttaaactttccttttcattcagtcatccaaagattgtggatacctgctgtgtttcaggcactgtgcttggggctgaggattcaaagataagtaagaaatggaaatggctttggaactggaaataaaaaagacttaccttagatttcactttaatgtttgttttataatcaaactgaggtataataagtcaagttataatgatttgtttaaataatatgtttaactcccaaagcagactgcgttgcatgtgaatttacagtctggtcatatatacattttgaagcaaactcatctttttcatctctctaaaatgccagctattagactataatgcttcacataagcaggggttggggaagaaaaaagacatatttttcgtcttttttaaggtgcaaggaatctgaaatctttattttccattgacaatccttgattaattttaaaatgaaattagcatgcctgtaccttcctctacttgtcactataatgtagtctgtgctgcaaaacaaccctgaagttcagagattcaacacaatagaagttcattttataatcatgtgaagtctcatgtgggtctggtacctctcctgggaagctcttcttcaaacattggtgactcagggatttgggctgctttcatcttatagctctgtcatctctatcatggagctttcaaggcctctgtgacaaagaaagagagaaatagggggtagtgcaccaactcatacttacctcaacccagcaatgaacacacatcattaacgttcacagtcggtggaccagaagcagtcctgtggtctaccagaccagtcatgtttcatatttcagttttgttcctcatctcaagactgaattggcagttatcaagtaacccatcaaaccatatatataatattatatataattatatatataatatattatattattataatatatatattattatattatatatatattatatatatattatatatttataatatatatataatatatataatatatatattatatatatattatatatatataatatatataatataatatataatatattataatatattatatataattatatattatattatattattataatatattatatataattatatattatattatatataataattatattataatatattatagataattatatataataaattatattattataatatattaatattttattatatatatatatatatatatatatatatatattttcagagtcttgctgtgttgcccaggctggagggcagtggtgtaattacagctcactgtgacctccacctcccaggtacaagcaattctcgtgcctcagccaccagagtagctgggattacaggcgtgtgctaccacactcagctaatttttgtattttaagtaaagacaatgaggttttgcactgtctcgaactcctggcctcaagtgatcttcctgcctcagcctcccaaagtgctgggattacaggtgtgagccatagctcctggcctgtcaaaccatattctaataaccattttctcctactgtcaacttacaacgaagtgttagattggggtttaaatggacactgctatgctatctagctatgcagtgtacatttcttaaaaactatgataccgttctccaagcacagtcatgtgtttttccaaagattgtttgctgtcatcattccagaagttatccatctatttgatcaaattccagtacataaaatatatttcaagttgctatattttagccagtctacttctgctctctggtgttaatagcatatacattttccaatgaatcaatttcagatggtttctattgcctttgaaatgaggatcttctcaaggacctagaatgttcagtgtaagctagaggggataaccagagattctttaagaataattcagagtttctccccaaactgagaggactgttttctccatatgtatagcaaatgaagatagatattggaatcattctcaaaaagcactcttattccatgaggcagagcttggctgggtacttcctaacttctactttgccaaatagatgtcctatttatgaatatttcacttgtttctagcttttataggtacatactgtgatgtgccacctggctatcccttcaagaaaggatttgttaccctagctgctgagactacagctagcaggctgctcttaagtgctagccctatgtcaggggtccctgagaccatccttaggcttgatgatttataaaaggactcacagaactcaggaaagctgctatactcatgttccagtttaatatagtaaaagatatatattaatatagtaaatattaataaatatagtaaaatatagtaaaattagtaatattacataaatttagtataatatataaaattagtaatacagtaaaaattagtaaacatagtaaatatagataatatagtaaaagaatacagattaacagtgaacggctggttttaaaagaagcataggatagtggccgggtgtggtggctcacgcctgtaaccccagcactttgggaggtcgaggtgagtggatcacaaagtcaggagttcgagaccagcctaaccaatatggtgaaatcccatctctactaaaaatgcaaaaattagccaggcctgtaatcccagctattaaggaggctgaggcaggagaatcgctggaatgcaggaggcagagattgcagtgagccaagatcgcaccactgcactgcagcctgggcgacagagtgagactccgtctcaaaaacaaaaaaacaaaacaacaacaacaacaaaaacagcataggagaaagcatgtgtgatcttggggttgtgccagcaatgcttcatcctctcagcaacagtgtgtgacaatgcataggaaggattgccaacaaggaagctcacctgagctttggtctctagggtttctactgggggctagtcacataggcctggggtacctccatgactgctcagtctccggcgtccaaccaatacagcatgaccagggccccaggtgaacaaaaacaggcattcaccataaatcacattgtttgcataaactatctggcatatcccaagaccccagatacacaaagacatttgtatcaggctaggtattccaaaggcttataggttatctcccaggatggtcaaggggccagtcttctctttaaaatgtgcagagtttgagtaccccaagtccactgggttaaccttgcacaagcttgcattcattcattcattcattcatttacacaagcttcttcaagaatcccctcagctttagagagttgccttgcccaagattgggctccttcctggggcagccaatgttcactgactcagagaatcaagagtttaaatgttttaccatttcatccccaaaacaggacaactcacattccagccttagagctccccagcaggttagctgaagatgttattgggcctacctcacagcttgacttctatttctgccccattcctgctaacttcccctattctgcatagctgttgaccccacggaaaccacttaaaacatctacatgctaaactctcagagtctgcttctcagggaacataacatgtggcaatatgtgaagctgaattgagtattttcatgtgtagatcattttgttacttctaaaagattatcttgatttaagtcttcaggaacatttttaactaattacatatagctctaaaattaatatggaaattgagtttagaaaaaaatgctttttcatagaatcccaatgtatttcatcaccaggtggtagagaagttcatccatctcaccccactctcgccagtgttagacttcatcctattgattgtagaccttctgtataagacaattggagttttcttcctgtttcctcaggttattagcttgacctcttttgataccattgcagatcttgtcaatatggccatatatctgagagtttgttcactggcacaattttattaggcgaggatttttttttctgtaatggtttcttgggtaagagtctcatcacttcatcataagtaagcttaggaggcctggggacaagattacttccatggtaccactcaccatggtagaagagacttcaatcactcagagaatatctgtggtgccaaactccacacatggttctttccatagttctgaggttattgatacttatccaagagcaacgctcttgatagtaacaacagacatgatgtcatgatggtcattgtgaattcacttaggcctgcatggcaatcgctaataaccctttgtttccatgccacctgtccagcaaatatttctgtttctttccctgtgtatcaggatttgtggataaataatgtatgattttaaattaaatgcattggatgaattaagttttgaaattaaggaaatttaaaaattgtctttaccttctgaatcaagcaacaccagagctgagaattggtgaatgaattagcaagctagcctgaaacccattcagctctttgttggggacctgaagtcatgtgttcatttcaactattcctcccatggtgagagggtggtggtgtgtggctctttcctttaccctccccccaagtcagggctgttgtattagtttatcattgctgctataacaaattaccatagacatagtggcttgaaaccacacaaatttattatcttctggccttctgggagtcagatgtctgaaatgggtttcactgggctaaaatcaaggtgttgcctggatgtgttggttctagaggttctgggacagaatctgtcggctgactttttctagctcctagaagctgtctgcactgcttggctcatggccccttcctctatcttcaaaggtagcagtgtagcatcttgacatctctctctgactctgaccctcttacctcccactttcatttacaaggacacttgtgattacactgagcccacccaaaaaatgaagaataatctccccatctcaagatctttagcttaattatatctgcaaagtcccttttgctaagtaaggtaacatattcacaggtctcaggggttgggatgcagacttctatggggacacccggcagtagaaatcacagctgagactctgtagcagttgtggactctaacgctaagagtatcatttttccccccattggtgtaggtgttcagcagtggctgttttgaatcatgcctggttcccatgtcgtttggatccttggcctattgccaggtcagttcccttattactactgcctggttctggatttgatcttctccctgttctttagaggtaacgtgtctgctttaagtcattgcttccttcataagctgcttgcttcttgcaggagacatctttgcactctgagtaccaagcagaccatcttaggacaaccctctcccccagaaaaattgagttctacaagtttggaggaacactcagaatatatcttcccccaaccaggcaacattagaaaacaagcaattgttggggcattatggtaggaaaatgtgtttgccaccagatcccattgtgtagaaatttccatttccatttagccacatttttctcctgttttcttctggctcacaggtgctcaatagcactcacctagttggttttgcacaagatactttgcggtatctctgcttagaatgtcacaccataaatgcagttgactgatctttgcattctttgacaactatagttccatctgctctatttagaaactaatgtaattacttaaactggagaagacagaactacttttgcagcaaagtcaaaacatgcatcaacactcgtctctataattacttcaccaggaaaaaaaaaaaaagcatcctcactggcttttcttacaaatgaagagagtcttccacagtaattggctacttactaagtaatatatgtcagatctgttcctcttaccataaatctagcctggccatctcaccctaggtgtcaagaagtcatgtagacaaaactcacatacttctgttgcatgacacagcattgaagaattatggccttttgagttaaatagatctgggtttgaatctttgactctgctactttcttgctaagtattactgggcaagaacaggggttggcaaactttttcagttaagggccagttagtaaatatgttagcatttgtggaccaaatggtctctgttgtaactactccactctgctgaaattgtgtcatacgtaaacaaatgggcatggatatgttccaactaaactttatttacaaaaataggttgaatttagcccatgggctgaattttgctgaatcttggacaagacacataaactctctaaacctcatataatattcataaagaatattaagagctaacttccagggtattgttaaaatttaatcagatattgtatattaagtgcttggaatagtacctgacacaaagtagatggtcaacataccttcaggtaaatggatggatagataggtggatggatgaataagaaggatggagagaggaagagaggtaaaaagaaagaaaaggaaggatcaaccatattaagattaaatatattgaacaatgatttgccagtttatgggagagagctctccctagctatagggataatggactgaatgaaactaattgagcaggtgactcatgttttgtcacgtggaatagagcaatagcgctatacaggtgagctgcagagacttgtggcatcacaaaaaaaaaggtggttgaaagcttctctgctgtcatctcccctgtcccactgaggagctattttctgtatcagaaccatcctaccttccctctgcctccttataacaacccactgtgactccagggagattattaaaatcccccacggaagtggaggcccagagttgcctatctcctgactccactgcactcccatttgccttctttccccaccctgtgtgtcttgttaatgtccagatggggtgggggctgtgatggctcctaggccttagggttttaggtctgtttctgcaaatgactgacctgttctcccagttgtcccagcaggcattacggatggatgaaaccttgcctataaaagtgtgcatgtgcccaagaaaagacaagacttcacaatatttgagcaaatgacaagcattccccattcgttactgatcatccttagaaacaaactgcagcggctcacactggagcatctggctgtaaaattttgtctctgaaacagactgtctcagattgcaactaaaatgttggagaagctttttttaaaaaaaaaatacgaaagacaggaaataaaactactccacaacactgaaaactagggctagaaattggagctttcttccaaaaataggacatggaattgttctgttgaagcctccgtagatgtgagctcaaatacaggtaaaaggaccgtttttgccttaccttgctaattattagtttagaaacaggacatggggccaggcatggtggctcatgcctgtaaccccagtgctttgggaggccaaggcagaaagattgcttgatgccaggagttcaagaccaacctaggtaacacagtgagacctcatctctacaaaaaaattaaaaaaattagctgggtgtggtagcatatacctgtagtcccagctacatgggcatgggaggttgaggcaagagggttgtttgatcccaggtgtgcgaggctgcaataagctctagcctaggtgaaagagaccctatctcttaaaaaaataaaaaataaaataaaatagaaagaaagaaagaaacatggaaaaacagtctgcctaccacattagtgctacttttcatgataaacatatgattaggtagtatgattaaatggatccagaattttatgagactttaagcatgaagaaaataaaatcgtaccaaaaatctgaaactcacacttttagaatctcctagatgtgcccggtcatcccgggcattgctttcagcagtatgttcattattcagacaaaaaaaagtaaaagatacagaaattgatgaccctttacaggagatcagagaggcccagtgtgataaggcttcacggtaatgtgtagctgtgatttaaatgaatgacagtggttctcatccagggaattctcattaagctcatattctgaaggcagagagttgaggttttggccaaggaacctgagaatttccttcactctcactgctagattggggacccaagaagtaacagatccttagtggtcaagtcgggccttaggaaggcctcccatggcctgggctattgtacagattcaactctcagccctgatgcaccatgatggattccacctgaccctctgtggctactcccagggggcccgtttctccgagctggctcaggccctgtgaatgtaggtcctctctgacttcttggaatcttgcaactaaagaggcctagctggggctggtcaaggcaggatgagaagtctagaagctaaaaagtgtagagggcaatgtagaaaaaaggagggtagcttgctgcatttagtagtgtactgaagaactgattttctacgcttgcaaaacagttccctttggttgttattgagcaaattttggaaacatgcaactgaatagggcagacatcctgtggccagtgggttcttagtctaatcagaaactcagctgtagagtggtaagtgttagaatggagatgtgtgcaagttcaaagggaacagagagcagagacttcttacctaagcttgaaggtaaggagaatcatctgaaaaatgggaagatcacctgtccaagtagcttaatgcagtggctgtatgactcagaatttccaagagatattcagtttttgatagcttttttttcttaaactagatgagcctcaaaatatatacaagtaatttgacttttatgtgaattttttaaatgtttggcttagaaaaatacggtcactgaaaacacaaaagctcgatagttagtctcatgctgttagctgatatcgaaaagtgtttagcatcaagacagccagtattgctggctctattctggttttggatggattgctggcatccattctgattttgatgaaaagttccattttgtagaaatgttctacaaaagttccatttctacaaaatggaacttttcatcaaaatcagaatggattaggtaaagcatatttgtgaacaagcactcaaggtaggaatatgtaaaataaatggactcatttcagtatatggcccttccttgtgagtgttcaaccattatcagattatcaatcactgattacctgatctccgagttgactgtttttctctctcattgtgttggttgatcctgtgcccatcaccacttgttgtttctaataatgttcctctgagaattatagactcacccacccatccatcacttgggtctctttacttctctgtgccctggtgttctgagattgagatgtggcatagccccagctacctctggagttgaggttgaagagagtggtaggggcagaggatgggagagggaagacagagactgacaaacagccactcagatggaggaacagtctgctacccagactcaatttcacagaaagaattaaagaaaaaaaaaaactagaaaaggttctggtatgtttcatatgctaggtgctctatatgtttcaattcacttcatagtacatacctattcattcctttattcgttctccctctttcatttttcttctttctgacacacgacttagcaaattaagtctttttaaatctctggtttatgcataataagaacgtgccccagagaaattaaacatcttctccaggaccctggagctagtagaggttaagctggacctcacagtgaggactttcagctccagaacccaactcctttgccattgtcccttgtcccatccattttactgcagttgcagaccactgattctgcagttatttgtggggccgctgtgtcagtgttcagctttttacctgctttgaaagaaagacatttaacagtgtcttgttaaagagaatgcttggacctgaccctgtctccttttcactttggctgccaggatgcctcaagccaaatttggaacttgactgtggtacctctggagtcccttagggctgacagatgtgtgcccttctggccaaggtgttcctcaccgtatatgctagtcctgactttttacgcttgtttgcattttgccattgtaggctgcctcaagccctttgtggaatgtggctgtgaataaataaataaatagctaactgaatacaaaatgtgttatgcatgtatccctaatgattgttaattaactatgatttgcagctgctcccatatttcccaccactcctggcccctcaaatctggatttctgaacatgcctggcgtttctcctttactctcttcagaacattcagaactgagttgggttatggggaccaagactctttccccatcctcatttcaacctaagcagttctgaatagtttgtgcctttgacacacttctcccaaagtgctacttgaggtctagccttttacttttaaaaatcgttaaattttttcaatagtttgagcacctcaataaatgcattgggctacttgcaatgttaataactcatgctgttctaaccttatgttcctgataaaggaattctctgccgtttaaggctctgggatgaataatagctgagtgtttctattgtcctcttaaaatggagattactatatgttgaatcacaacagaactacttttttatagactgtgaatagcatacaggtccatcatgttgttgcaggcagcgccaacagaatggataatggcaagccaattattataaataatgccttgtttccctttggcccctgtgcaaatttcacagagcaggattctatgaaaggctggtaggttaagttaaatatgacagtgttcaccccagcacctaggacagtgcctggtacaagtcatggcttcatgctagctgaatcagaatctgagttcagcagggttttttttttttgtttgtttgtttgtttgttgctattgttttgttttccttcgtggggctggggcaggtgtggcagggtatgagctcaggtgtattgcagagctcctagacagatgagcagaatactgtttggtgaggctggttgcagtagaaccaaaggaggaagaaaacagaaagggacattctagcagagcaaatggggctaaggttagcctgagagaagagccaaggctgggtgtgggaacacaagtccaggactcagagttcaggaaaatcaggagtctcctgaagtatgggtatggagttggctaaaacaaggggtcccagaagaagcacgtggatgaagtgaatatgccagagtttctgccgggtgggatgttgacatgctttgcaaaaattccaataactcgaaggccctagcagaatgatgccatgtccctcaggcctctcacatggagatggaataagcactgaattctatcaccatttcatcccattccgtagagtttaaccttgagaaagtgtaactattctctctaaaccttagtatccttgttttaaaaatgaaggtgctgaaacaggagagttccctgcttcccccacatgacatgtgacaggggtatgcctctctgttcagctgccacaagctcaaaccccttacgggagggggagcacacagacaggcaggtttaggagccagggcaaggactttggcctctggccccctggttgtctctaagggtgggtgtctgcgactcctgaagcccagcgggcatgttacagcatgctcttttggctttgcaatctgcagacagctaaagttaaccagctcagtgccctcttggcacccgggttcttgtttggagtctaggaagaatgaggctgcacatggacttaaagagtgaatgtgggggtctttttgagtggtggaggtggctctccgtgggatggatggggagctagagggggaatggagtgggaagatgattttccttcttttctcttcttctctgctgccccattttgccattcgtccgtgcatttctttctggagcctggggttcagggtttatatggatgcaagatagggggacatagcaggccaaaaggcaactttttggatgcaaaaacaggaatgcctgttctcactgagggctgtgggtttcttggcttgaaggtggggggcctttgcccgggaactgccttcttcaaaccagtatttccctatctcctgtccgtatcagtgctggactccatgttctgtaagatccatgcagtttttttaccccaggctaacatgcattttgaagccatgaacttttctgtttctaatcttgttttttatttcgacatctattgttctacactgacttctatttaacatccagctactgtactagcaattgtaattccacccaacaatggagccaaagaccaagctgagtggattgtgggaagtataatttaatgtaaatgcctcccttaaaatttaagtctggccgggcacggtggctcatgcctgtaatgccagcactttgggaagtcaaggtgggtggaacaggaggtcaggagattgagaccatcctggctaacaaggtgaaaccccgtctctactaaaaatacaaaaaattagccggcatgttggcgggtgcctgtagtcccagctactcgggaggctgaggcaggagaatggcatgaacccaggaggtggagcttgcagtgagccgagatggcgccactgcactccagcctgggcagcagagtgagactccgtctcaaaaaaaaaaaaaatttaagtccatagagaaaaagctacatgtactccaaagctagcattacacaaatcaatgtcatacccatgattttcagtaggcagtctccatatgccaggacactggtagaggaacaatatattttctaaggtagaggcatattcaaatttaattcatgttaaggagagccctgtcctttaggatgtaggtgtgcagaacggttagcaaagtgtcaaggaaatttgaatctgagagtactttttagagaactatgaaatacttcaggtgactgtcctgacctctctcatttcacctctgcttttcttaaccctgccaaaggggtctttgcccttcctaagtccatcactcagcctactgctattagctgttctctttcataactattattggatgtaggtcacccatgggagatgtaatattagagaggaatgtgggcatctgcaatttaggagaaaaaagtagactggaagtagacatttgagagtcaccaggatctaggtagtagtttaattcatagtactagatgagatcagaaagagaagggaaagagcttgaaaacaatgccaagaaatgcaaccattgaacatctagggagtggccagcacagcaaatccagaaggaaaactgagaggctataggatcactcagaagccaaggaattccatatttaaaggaggatgaggtcaatggcattgtatgcttgccaagcggccccttaagagggcaatggaggaatccatggcaggagaatttacaatccacaggtgatggcaagagtctgatagaatgggttgaggacaagaaaagtggagataacttatttttctcttttgatgaatttggctatgtggtggggacaggaggttgttggagagacctggagataagagctatgggtgttcttgagggaaaagatttggacatgtttaaatgctaatggaaaggagccagtggagatggggaggttgaagacagaagcaagagggtaattggtgtgggcaaggcccgaggagctggagggcaggcgatctagagcccagggggaaggatgcaccttgctttaggacagggcagagggggaaagaaaggaggcaggtgatatggtttggctctttgtccccacccaaatctcatcttgcagctcccataattcccacttgttgagggagggacctggtgggagatgattgaatcatgggggtgggtctttcccatgctgttctcctgatagtgaatgggtctcatgagatctgatggttttaaaaacgaaagtttcgggggaggagccaagatggccgaataggaacacctccggtctacagctcccagcgtgagcgatgcagaagacgggtgttttctgcatttccatctgaggtaccgggtttatctcactagggagtgccagacagtgggcgcaggccagtgggtgcgcgcaccgtgcgcaagccgaagcagggcgaggcattgcctcacttgggaagtgcaaggggtcagggagttccctttcgaagtcaaagaaaggggtgactgacgcacctggaaaattgggtcactcccacccgaatattgcgcttttcagaccggcttaaaaaacagcaaaccacgagattatatcccacacctggctcggagggtcctacgcccacggaatctcgctgactgctagcacagcagtctgagatcaaactgcaaggcgacaacgaggctgggggaggggcgcccgccattgcccaggcttgcttaggtaaacaaagcagccaggaagctcgaactgggtggagcccaccacagctctaggaggcctgcctgcctctgtaggctccacctctgggggcagggcacagacaaacaaaaagacagcagtaacctctacagacttaagtgtccctgtctgacagctttgaagagagcagtggttctcccagcacgcagctggagatctcagaataggcagactgcctcctcaagtgggtccctgacccctgacccccgagcagcctaactgggaggcaccccccagcaggggcacactgacacctcacaaggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaattctaaaacgcagagcgcctctcctcctccaaaggaacgcagttcctcaccagcaacggaacaaagctggatgcagaatgactttgacgagctgagagaagaaggcttcagatgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagggatgccctctctcaccactcctattcaacatagtgttggaagttctggccagggcaatgaggcaggagaaggaaataaagggtattcaattaggaaaagaggaagtcaaattgtccctgtttgcagatgacatgattgtatatctagaaaaccccattgtctcagcccaaaatctccttaagctgttaagcaacttcagcaaattctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagtttcaatgccatccccatcaagctaccaatgcctttcttcacagaattggaaaaaactactttaaagttcatatggaaccaaaaaagagcccgcatcgccaagtcaatcctaacccaaaagaacaaagctggaggcatcacactacctgacttcaaactatactacaaggctacagtaaccaaaacagcatggtactggtaccaaaacagagatatagatcaatggaacagaacagagccctcagaaataacgctgcatatctacaactatctgatctttgacaaacctgagaaaaacaagcaatggggaaaggattccctatttaataaatggtgctgggaaaactggctagccatatgtagaaagctgaaactggatcccttccttatgccttatacaaaaatcaattcaagatggattaaagatttaaacgttagacctaaaaccataaaaaccctaggagaaaacctaggcattaccattcaggacattaggcatgggcaaggacttcatgtccaaaacaccaaaagcaatggcaacaaaagccaaaattcacaaatgggatctcattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggccatcattaaaaagtcaggaaacaacaggtgctggagaggatgtggagaaataggaacacttttacactgttggtgggactgtaatccagttcaaccattgtagaagtcactgtggcgattcctcagggatgtagaactagaaataccatttgacccagccatcccattactgggtatatacccaaatgactataaatcatgctgctataaagacacatgcacacatatgtttattgcagcattattcacaatagcaaagacttggaaccaaccgaaatgtccaacaatgatagactggattaagaaattgtggcacatatacaccatggaatactatgcagccataaaaaatgatgagttcgtgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaagtataattaaaaaaaaaatagaaaaaaaaaaaagaaaacaacaaaaaaaaccgagagttcctctatacaagctctctctttgcctgagaccacctatccacgtaagatgtgacttgctcttccttgccttctgccatgattgtgaggcctccccagccatgtggaactgtaagtgcattaaacctctttcttttgtaaattgcccagtctcaggtatgtccttatcagcagcatgaaaatgaactaacacagcaagtaaagggaaataattcattgcagggtggtcagaacattcttttgggatggcctctgtttgcttctgtgaagtaggaggtaagatcatttcctgaagttgaggggatagaggagcatggtgaaagttgaaaaaagctgcagtggggaatagaagggggtggtgacaaaggagtgttagctcggctgacactggaacccacgctatcacttggagattgtacagttttctccagcagtgctcaggaccctgattggggcataggttcaaagaaagttgtggttggattgatacaaggtactatggacctgaattatatgttgaagtcctaaccctctgatctcagaatatgaccttatttggaaatacggtcattgtgcatgcagttaaattaagataaggtcattaggtgtgtgtgttgggggtgttcaaatccattgtgacaggtgtccttacaaaaaggggaagtttagacagagccatgcacttggggagaatgctatgtgaaattgaatgcagagatcagggtgatgcttctgcaagccaagaaacaccagagattgccagcaaaccaccagaagctaggagagaggcatggaacagattctttcacagcccttcaaaggaatccaccctgctgacaccttgatcttggactttcagtttctagaacaataggatgataaattcctattgttaagcccccaccccccacccagtctatggtactttgttatagcagctctagcaaactcatacacaagggatgtatatttttttgtccttttccttcttttccccttcaagtggttgtgaaggactgaaagcaaacgttttgaaagcacattctaaaagtattattaaagagatagctcaagaaatattcaaggtgggtaggaaaggagataaaacagaagagactgaatagaaaggaaaaggaaagactaagggatttagtgttgaaattttctttcagcttagacagttgtaattgtgagtagctcatagaatctgtctcttgggaagtctcaaccctattcaggatttccctgtaaagggtaatcttagcctccaggtctgtgctaaagtgatcactctgctactcctcaaattagatctgcaacttagatcatagccaaggtatttgcaaataatcatttcttgttaggcattgacttacatttacatatgataaccagagatcttatatattctcagagggaagtttcaagttacctaagctgtgtgtgtcttcaaagagctgcataactagtatggatttaacgggctattcgcccagtgattcagcatttgctaggttccagttctcagagaatttgctcattagcttcaaaagacagctttttaatggaacaaaataaggggcactgcaagttgtggtttcaaaagttactgtgattaaaatcatatggacagctgctgttcagtatggcatcacctggtgtgaatgaaaaagtgctcactgccagaaagccattgggctgtaaattatgtttactgtacaactggccgcagtctgccaagtttaaagtttttggaatggtccatgaatagactgttgagcagaaacaactttttcaaaaaaagtttttgcttcatggaagaaaatgtggaaaatacatgaaaataaaaatctttttaaaaagcagataatctcttgagtgttaacatttagggtgtctatccatctggtcttttttccccctatgcataaatatacatacatacatttactaaatgggaatcatactgtaaatacagttttgaaacttgctttagttaacatatcctaaccacattcccacaccacagaaacactctttccatggtggaccatggtccattttgggggttatcataatttatttaatcgattgtctctctttggaaattttggttggttttagtttttttttttctgttaaagatgattcagtgtatattttcaatatataatgtcttaaaagcttgaggcttctgggtttgcatgataatctgttgcatgtcagccagggaagctggctggcatctgtggagcagacagctgtctactactgagtccctctaggagacttttttgagcttgaaatacaaggtcttttaggaggagggcactgtctaatatttacttttacaccatggggagggatttgatggaaacagaaatgcattcagaaatggctgcatggaaaatgggcttaaatgcaaagagtgatgacgtgtaatgtaacaggggagtctcagctgctgcctgggcttctgtcaagttgaggctgtgactcacagaaggggttggggtggggggtgtttctcccctcttccccattctttcagaatctccatgacagaaaatttgtaaactgttcttgctgacagttgtgcaaaatgaaaagctcggtggatgtgtggagaatacattttcctgactgctgttaagcatttgacaaattgggagttttgtcatatatcgaagaacaatggtgggagagtagggaactgtgtgcgtcacataaatacaacacacctgacactgatgctccctgcatcagttgtcttcctgtgtggtggggaaggggaagagtcaggagatgggtgggtccagcaggtgctgacctcattcagcaggaggctgaatgatgcaactcacgaccaagggcccatgtcagcatgggtcttaggaggtgctaggttgtttagggtcctgttcattacgattttttgaaccaaagggagatttcctggaagtctgatgtgggagatccctgaagccattgatggaccaggcaagagcctcatgtgctccaagaggtgggtgaaatagctatggagccaggtggagcctagtggggctggatctgggcactgatggaggggttggggaagagaagcatgttggtttatttcatggcagtctgggctggctctcacccttgacagaaggaatgcccacagccaggaggggatggttccatctcaaggctcagggaaggaaggtgagtttggatagaaagttcagtcgctgtcattcctgaccatctcagcaatgagtcacacgtggaacacaaagataaacacatggagagggctatgcaggtggcgtgacgggcctgagagtggactgggatacagggaagtgggagaggtgtcaggcaaacctgacaacacatctttatgcctctttaccagctttgcaaccttgacaggctcaacctcttggagcctcactattgtgatctgtacattgggatggtagtgcctgcccttatggcagcgttctgaagatgaaatgagataacataaaagaagcacctccccacccagtaggatggccaccatgaaaaagacagataataacaagtgttggagagaatgtgaaaaaattggatcctcatacactgttgttgtgagtgtaacatggtcagcctctttgaaaagcagtttgggagttcctcaagaagttaaatgtacagttccatgctcagcaattccactgctaagtccatatccaagataaatgaagacatacatccacaggaaaccttgtacatgaatgctcatagcagtagtattcatgatcaccccaaaatagaaaccgcccacatgcccatcagctgatgatcggataaattaaatatagcatatccatacagtgaacactttttccacaataaaaaggaatgaaggcatacatgctgcaacatagacaaaccttgaaataacatgataagggaaagaagtcagacacgaaagactagtgtattgcaatgttcagaataggtaagtctatagacacggaaagaagattagtggttgcctaggcaaagagtttgtgtggaagtgaagggtatggaatttctttttggggtaatgaacattttctaaaattgacttacaatgatggctgcataactatgtgaatatacgataattcactgcattatacactttaaatggatgaattgtataattgtatggttgtgagttttatctcacaaagggtgttatcccccacaacaacaacagaaaaagaaaaaatgtgcctgacacacaagcaggtgacttatttatataattctaaaccccttcctgtctcacagattagtttggaaaaggttacagggcttcagttctcaggttttcaagttcaaatctacatatttcaggtcaggcatggtggctcacgcctgtaatcccagccctttgggaggccaagatgggaggattgcttgaggccagaagttcgagaccagactggtcaacatagtgagaccccatctcaaaaaaaaaaacaaaaaaaaaaaacaaaacaagtaaacccgcagatctacatatttatgtccttaacatgttgtctgctctccaaaaagagacactgagccttcatttaagccaaaagtgctcacaagggtgacaccctttgtggaatgagtgtattgcagaaaatctgggagtctgagctaaaagtctaagtttctatcaaccaggtttttttccccccatttctacagagagcacttttattcacgtgaaagtgtctatgttgagtctgtgtatcacattgcaaaatagtcgctgaaaaaagctggtgttccagagaaggaaagttcttcccattgtctaacttgagtcttcctgcagtaattgaagcctgcttcccgccacccatctgaattctgccatctgttgaggttggatgcttggagtcaaatgaaataagtgcctccttggagaacagctcctggaggccacagcacatttgtcacatgtcactgggatctgcatatggaggtgaaatgtatattttaaaatgtgctcacgctcggctgcacattcatcctgttctgaatgtgtttatccaattgcccatcatagacccgccctggggggagtgggggtcagctgatctgctcttatttgtctgccagcctacagcctccctagacagcacacatccctgggccgccctgttccttgcccttctcctagaggaagagaagctggaaggctctggtttgcagctggttactcagctctaaagatggattccatatcttggtagaaagaacgaggcagcccagctgctatagcagccagacctgggagcaaagagtcagtgttggatttggagtcagcagcctccttttgaacactggctgtgacacttagcagacatgtgacattggccataacaagtgtcctctcgtggcttcagttttgtcatcaataaataaaggcaaggacctaggttccttaaggaccctaaaacttatgcctcaaggatgaaaatggtttaattcaaagtgttgggggctgggtgcggtggctcaagtctgcaatcccagcactttgggaggctgaggcgggcggatcgtttgcggtcaggagttcgagaccagcctggcccacatagtgaaatcctgtctcctctaaaaatacaaaaattagcccggcatggtcatgtgtgtctgtagtaccagctacttaggaggctgaggcaggagaatcacttgaacccaggaggtggaggttgcagtgagccaagatcacgccacttcactccaacctgggtgacagaaggagactctgtctcaaaaatgaaaagaaaaaaaagtgttggagtgttctgtattatcttcctcatagagacggggtgggtgtctgggactagggtattcaaactcaatcctataccaaaccctgacgtccttccctgtgatggctttaaaacatggcccccaaatctttgacactcttcccatcaagaatgtctctgatcccttcccttgggtctgggctggctaaaactgtaccttccccttgagaaaagttggaaccacatggcatttgagggtggtctcttaggacacttgttcccttgaagatcttctccttcagaactcactctgtatgcggtgagaagcctggaccccatggcaagaccctaagtccgtgctccaggtgacagtgccagctgggctgaccttcagccatccagcccaagcacgaggcgtgtgagaaatctagttggaaatcaattccttcagctccagcagctccagatctcaggcatccaaatctcccctggctgttccagtcttcccatttgatatcccagacaatattgagaaaagcacgccatctctgctggatcctgtgtgcaaatcctgctatgttggaacatcccagcattgtttatcccccagacagagtctccttcctcctgccctgccccaaatcaaagctattatccaaggacaatggagggattttggtgcttttcattctgcaacagagaggcagctttgacagcacgggtatttacatcacgttctgggtttccagagacctcatattcattaatgaattaatcctttctggcaacggtcctctttatagagtggcatcatgatgtgtgttcatcagacaaggggactggggcaggggctgtggctgcccatgatgcatgaggcacctcagctgtggctattgagtacttattccggagacatgagaccatgaggtgccagatgcagagtttgggccttggagcctggagtctggatgcaagtctaccctctggttattccttggacagacagctttactggtctgagtctcagtttcatcatctgtaaaatgagtggagatagtactcccaccagggcatagatgattgggtggcacatgaagatgctctgtaagctgtgacacacggccagtgtcattgcttctggtccacatgaggatgcccttatgagctggtgtttcagggaggatcagcagttgcacctgggataagggtaaggctgtgggcactgtgagaccctctcagattccccgggcccatgataatgaagaagacccggaagcaaaagcaagcgcccacaggtccctctgcctgctcattcaggctcccccgctgtgcactcccagccccatgcaatccgcccatgcccacaccctcatgctcatcaccctcacatcctggctttcttggttcaggcatgttcagggcttgttttgttctttattttgttgttttattttcttgtgttcaggaagcatttcattgttgctccaagtttaagaattttcactgatgagtgataaggaatcaacacttcaaagcaatgtcttgcgtatccctgctcagcctctgaatcttgggtttggctgacatattaatatatttctgtgcagtcccagtggtcattccgttcatgattggtggctcagtcctaacttccagttccaagatctggcctttacacaggaagctgcttagaatctcttcctccacctcccatttttttaaattgtggtaaaatacaggtaacataaaatataccatcttaatcatttttaaatgtagagttgagtagcgttaaatacactgataatgtgcaaccttcacaccatccatctccaaaactctttttcttgcaaaatggagactctgtgtccattaaatacgaactcttcatttccctcttctcccaccccccggtagccaccattctacttcctgtctctatgattttgactactcttaagtgtctcatgtaagtagaattatataatatttctctttttgcgattgacttatttcaattagcttaaggctaatctatgttgtagcatgtgtaagaatttccttcctttttaaggctaaataatattttattctatgtatgtgccacattttaattattcattcattcacccatgggcacttgggttgcttccacattttagctgtgatgaaaatttagctatgatgaatagctgctgtgagcatgggcatactcagtgccacttgtagttcaggatgagtggccccatctaatggaaattcagtggcaactggacacaatgcttctccatgctggacagtcatcatggcagaaaaggcagaaaaaaatgtcgggggtaatgctcaaatgaccatgtagagcaaataaattaatcacattgagtgtgagggaagaaagccaaaaaagtggggatcccagctcaaaagctatttttaaatcttggacaagtaactcagtttcttggagcctcagtttcatcatctgtaaaatggggatcatgctttctatatcacaggctcatttctctgtcgtatgtgcagttcactgacagaatggagtgaacatgttttatcaaccaaaaggtattatatgaatggcggctgtcattcccccagggcctggcacatagcaggtgctcaaaaagtattggcagaattaattattgctgttttctttgctgaaatctgtgagcagttggcaaggctgtagcccccatactttttctgttctcattctcttgccctcagattggctttgctgaggtcccagatctgctgggctggccctaccacatcagccttggtaggtgcctgtgtgtgtgtacatgtctccctgcaagagtgtgtggcccagaaggtcagttctatttatcttggggtggaaggggtccctcagggaattagaggtgagtgaagtggagtcacaaaacacagccagagaaaaatctgggcccagagaagagccaacggggctcacaatgtggtctaagccagcatttctcaacatcgtgcacaagaatcactggcgattctgttaaaggcagattctgatcctgtagcctgaaattcttcatttctgttctactgcctgcagtccaccaaccacactttgagcagcaaggctctgagaccatgcctccatcaggctcatgaaggatcgtggccacatgacatttctgggtcttgcgccacatctatagaatctgactctagggccagggccctggaacctgcatgttgacacattctccaggtaattctgatgcatcctgaaacctgtgaccctctaatcggtggactgaggtaggaggctctgggctcctgtaggagggggagagagcccgtttcctggtatccacattcctccccacagcagcatccaatggttggttcctgtgcagatcggtctttgctcacattcttttttatgccagtttctgaaagccacaaccacttaaatcaatcatttgcaaacttcaccaggaacaccctttgctccaaggtatgaagcatatttggataagatagtgagacatttgtgaaaattgaggtcgagaatcgatggctgaggctgaggcattagctcagccatgattactcatctagcccttgacctttctgcggagacgtctaagaagtgagtaaattaacaccagcagggagtgacaagggcctgaagacctgcagcttttctcactcagggactgatgagcagaactgagcctgggatgtcagtgttaccaggccccccttggcttttgaatctctttgcctgcccctaagcaagggcagtgagctcccctactgcaggctgtgtcctggggtcagtcctggcctgagcagaaagtggctgaatggattcagccatgggtccagctctgaccacgtgacccaccttcacctgctccggggcaggtctaactggattctgaatggactcctcaggcattcatagaggcctgtgccttgcatgtgcctctccctgtagtgcttgggtcacgcctcactccatgagttctactttcatctctgccctctccaaccgacagagactctgagatgcttttcctcctttgaccttggagtctcacagcctatatcagacacccctgctgatagcttgcctgctgtcagcaacacaaacccctggactgggtttcttgtcaatgcctgaaacaggagtcaccctctcagcacacaccaagcctcaaggggggcctgggtcaactgggcaggcccctatcatgtttcatgagccatgccagtgcaggccatgccaggcaaagtatggtacaattatggaactcaatgtcttcggggtatagaagagagatatagaacatcactgggcctcagttcccccaactctaaacccttaggaaggcttattgattccaatgagtggctgggcccagagctcttggggtgcaagcatctccacctagctccctagtggatgtgtgcatgagaagaatatgaaaatgagagaacctcttcctagcatgttcttctctcaccatagccacccacattagtgctaggtaaaaaggaacacaatcaggagaaaaaaaaaagagaactaaatctgctactgaggcattgttctgggatattatggactctcttctttaagagccaaaagcctaactcacagtattcatgagctcctggggatccaaataaaccagattcctgtctccagagggatcgcatggccccaccatctcatgcccaacatcagtaattcagatgagtatcaaatgtgacaggcatttattttaacagagaggaaggggaagacaaaatatcataaaatgtgtgggttttccccagatgactctgttgaaaaaaccaggaaatgcagagcggggggacaaatggaggagagatattaactagaacattgctgactcaaggccgtccagcttcagtgggagttctgattaggccccatgtctgcctgatgccacctgcaacatgggctccgcatgtgccaagacactgagaactgtttgccgacacttggtgtatttgtcagtgatcttacttttcagtgtatttatgtgctaatcttttattattggatttgcttctacaaatatgtttttaccataagacaaagggaaaaggaagatgttggctctgtggcaattgttttgtctggattttctaagggagccccaggttgagaagagctggatatgcatggaggagggagtctggaaggtgggtggagagtgatgactcactgtttgcgccaatatcctctcctggatgtcttgggaaacacatctacggggataaagaagaaatgtcattcttgtccgtctatggagtgaagctttgaggtctaacatttatcacaatctccaggttccacttctaaatgtattccactccttttatccattcttcacttcttatcgagattgagcttctgaaaacataaatcacatcatgccagttccctacttaaaatgccctaagagcttcctattgcacttacaatgaaatccgaactccttgtttatatggcccacaaggcccagcaagatctagtcgcaccagcctctcaaagctcatctccttctattctcctggccatgcactatgctccagccgtactggccttatttggtttcctagaaccctctaagttttttgcctgtttgcgttttgcacttgtcatttcctttgtctaaatcgtttgtcccctctccaccccacccctagccccctggatcttcacttggctggctgatgctgctcatttgctcattttagtctcggctcaaatatctcccaggccagtctaaagcagttctctccctcacaccctcctccccagcataccattactacatcactcgtatctcctgtttattgtcttcttgcgctgattgtctctgaaattgtgtgtgccattggtgtatttgccttttaacttctgtcactcatcactagactgtaagctccgtgagaacaggaaccttcccaggaccccaggcaatgcacggtatgtggttggtgctcattaaagaattgttgggtaagtgaataaatgaataaatgaatgaggagtgaagggaacagagcacccctctgttctgccttgggacttcccatttcagagcatgcaggacatttactgactcttaagtcttaagtgtttgccaaggtactgtgaaatgtttatcatttccattttacaaatgaggaagttaagatttaaagaggttattcaatttgcccacaatcatataagtaatttggcacagccaggggtggaaatcagttctaactgactgtgaagcccctgctccttgttctgtcaccatctagtatttagcattgtttgtggggtggccaggaaggcttcatgaaagaggagcatatgtagctataggagaaaaaaagaacatagtggtaagagtatttgctctggaatcatgctgcctgggttccaagcttggctttgcccattcctaataatgtgacctgtagagtgtcctaatgtcactatgcctcagatctcccctctgaaacatagagatattgacagcatttccctcacagagttgtcaggagagttaaatgaaaggatatatagaaagccgtttgaccagtgtccggcagaaagtaagcactatcaaataggcgtttattacccttatgattattatcccattctacaagtcactttgcatgttgctgaatcttctgaggggttcctaagaacaatctagtagcatgagggtcttaatggaaatgctccagtctctcccaagacttgcaggagcttttaggagtttctctgttgcctgtgactttgcaggaaagtggtgatgtgctgcctgttgtgcacaaaggaacataaactttaaaagcagagaagaaaatgaatgtgttagtggcccagagttgtgggaaaagccacccactaaattacatttctgtaccaaaaatggacttcaggcaaagtgggaatgaacgacattgggatggcaaagacattgagaagcagagccggtaacaaggcatggagccctgtattatttctggtatcaaggaatgtgtggtttcattattattttcataaatggtctcagttcagtttttgttgcttgttattcacacccagggcacctggtgttcaccatgcctgcatcctgcccggcacagacctccgcctgacagtcagtctgctagccagaaattgatagctagagacaaaagagtgccagagatgttcttgggaaccagcacacctaaacatgctcgtttacagatgagaaaactaaggtcatgatgcaaagggacatttatttattcattaatttagtaatgatttattgagatgtattcattaatttagtaatgatttattgatttattgatttgttgtgctgcgtcccaaactaggcactggagaaaaacaaaaggatccttttcttgtagagtaaaccatccctaacgaactcttatagtagactatttaatggaggtaacatgtaaaaagaccaagtctgagaattacaagtcttgagttgcagtctaaactttgtatctgactagattaatttactgagcctcatgtttcttgtgtgtaaaatgtggaagatggtttctggccttcaaatctcacaaggattttatgagcacccagataatcgtgacatgtgctgatgcttgatggcctacaaagcgatttgtagataatgcttttgtgacgggtgagatggtaatttgcaatcacttgcatccactggaataatataatgggaaaatgaaaggggtgatggtgcaggtagaaggcagattgtatgttggagatggagcagagaagagccaaaggtgaccctcaaatttcattctgaaagggggtcttttgcactgtttggaatcaatgggaaagaattttccactatggagagtagctcattctatcaggcgggagctaccactcactagtacataacatggtagatgtggggatggagctgagcatggtactgagacaaggcacagcaacctacgaactcagagtagtgtgagagatgcagaatcataaacagaaaggttcaatgcagtgccttgacattgactcaggacagagggatccaaacccaccctgttagaaaggggttgaagattgccaggaggtgtactcacatattccttgtggtattattcacaatagcaaaatcatgaaaccaaccttagtgtccgttaacagaggactggataaagaaaatgtgttgcatatataccatggaactctattcggccataaaagaataaaagtatgtattttgcaacaacatggttggaactggaggcaattgttttaaatgaaatgactcaggcacataaagtcaaaaatgctctcacttataactggtagctaaataacgggttcacacaggcgtacagagtggaataagagacattggaaaccctaaaaggtaggagggtgggagcagggtcagagatgaaatactacctatcggcgcaatgtacactatccggtgatatggacgctaaaagccaacttcactactgtacaatatatccatttaacacaactacaattgtacctttaaatctataaaattaaaaatgtaaaaaataataataataaaaaatcccagccaggtgtggtagctcacacctgtaatcccagcactttgggaggccaatgcaggcagatcacttgaagtcaggagttcaagaccagcttcgccaacgcggtgaaaccccgtctctactaaaaatacaaaaattagccagactttatggcgcacacctgtagtcccagctattcaggaggctgaggaaagggaattgcatgaacctgagaggcagaggttacagtgagttgagatagtgccactgaactccagtgggggtgacagagtgagactccatctcaaaacaaaacaaaacaaaaaaataacaacaacaacaaaaaccaaaataagtaaaattttaaaaaataaaaatgaaagatcccccaggacagatgatgactgagctaggttttgaaggctgcagagggctgaactagttaggttacatctggaagggcaatcaaggctgagaggacaacacaaagagtgatgtagtaagcttaggaaactggatgtggctccatggagaggcctggggcataagtgggcacggtggtagggaccattttgcagataatttgagtgccaggcagaacctgagctgtgcaaggggtggtgtttgtggaaggctgtcttgcaatggtagcttggtggcatttgattaagatcccctgattacaaatgtaaaattaatgcccagagtcagtcttctccccattgtacatgctctttgacatcactcatggctttatgaaatgtgcggccagttctgtgtaaagagttttcagagtggggatgcaggcagcctgcatcatccagggaaggcaaatgaaggacaaaatcatcccactgcagagggaaccaatgcaaatgagcatcttcccagatagcagagtagcagaccctggagctccttagcctatgcagtgcctgacactgtaactcaaccctcccattgcaccccatctctctgggcttgaggaagtcacagaatcctaaggcagggggcatttcatccctgaggagggatagatgaattttactcagaagacatgcatcaattaagctccggtggtttgcagaatcaaccctgtgtgtggtgacagctgggaggatgacataaggagctccttgtggcacctcccagatgtctctgctcatcaaaccctgtgtgttcaaacctgaagttgtcatgttttctctctcaaaagcttttgctccatattcaggcaaatgtcaccacccagttgtccaagccagagtatgggcattaccctcaatgcttggctgctgtggacacttactcccattattccctgaattctgtcctttccacttccggtgcatctgcactgctgctcccttgccaccaggtcctcaatatcttactcctaataaaccagggcatcttgtctccctgcctccagtttgctccctcaactccatccttcaccattgcaaataagatgattgttggaacactttgatttgcttacaaggttctagcctgccagtatcttcttcattcgtttatttagccgccgtgaagtactctgtggcaggccctgtgacaggcactggaggtgcagaggtgaacgaggggtgctgccatcagtacccttacagcctgatgggcgaggcagccacaatagaaggcactgttaagccatgggaggaagctgtggtcagtgagtgctcagatgttggaggccatctctgcctggagaccagggaagtgagactgcatttggctattttttttttccctatgtatggttccttttctacacttaaaaaaaagatagcaggaattggtttgaaaaactatgaaaataatgtacatgttgtattggaaaaatgcagaaaacagctaaaatagaacctcaagacatcccataataccaacgtctatctagcctctattaaaattttgtgtcttccctaacaagttttcttcttctcatctatattttacaaaacataagatgcccttgagtatactattttgtacactactcattttacaaaccaatactctcgcatttaaaaaacagctcttttgttgtgtcttgttataaaaggaatacacagctatttcaaaaagtttcacaccataaaaactacacagaaaataaagattgccatctattcccatacctgaagatactgtctgctaatagctgtatgttattttacaattttaggttcattttcacagttatatataaatataagtgtagatggacttaaacttgctatttcctcttaatacatcatagcactctttttacttaaataccttttgatcacttgtgtttttttttaacagctatacgataggccatgtgcatatatcataaattatttgaactcatttttatggatattggggttgctactatagtatatatattcatgatttcaaatagcagaatgatgaaaaggcttctgtgggcatatatatgttctagtccacttaattctttgggatatagtcctacaagtgagattactatggcaaagattgtaaacattttaagttttggtctatatatgctgttggcagaattataagatgatctctgatgatctgtgtctttctttaatcccctccctttgggcatgggtggaacttgtgacttgcttctaacccatatgcattactctgttctcaccctgctataaagaaatacctgagactgggtaatttataaagaaaagaggttcgattgcctcactgttccacaggctgtacaggaagcatggcagcatcagtctggcttctgaggagatctcaggaaacttaaaattatggcggaattaaggggaagcatgcaaatcttacatggccagagcaggagaaagagaggttggaggaggtgctagacacttctaaacaatcaggtcttgtgagaactcactcactatgcagtaccaagggaagatgatgttaaaccattcatgagaactctgcctccatgatccagtcacctcccactgggtctgcttccaacattgggattacaagtaaacatgagatttgggcggggacacagatccaaaccatatcgccatagaatatggcaaaggcaatgggtgtcaatcctgtgaatatgtttcaatatatggtaaaagtgaggggattttgggataaaactaaggtttctaatcagatgactttaatcaacagagttaattttgagtggtcctgacctaatcaactgagacattttaaaagagtctggaagtcagagaccctctttcctgctagcctggaagaagcaagcctcaaaaagtctgcagctgcaaggaaatgaattttgccaataattatgtgcgcttggaagaagactcagcctaagatgagatctaagccctggctgacacctccattgcagctttgtgggaccttgagcggagaacccagttaagttctgcctggactcctgacccactaaaactgtgagaaaatgaatgtgtgttgttttaagccactaaatttatagttatttgttatgtagcagtagaaaacaaacacaatgtaggaaaattgcctttgataaattatacaccaatttacacttccaaccattatgagagctcccatttttgtgaatttttgtcaacacctgctgttgccaacctcttacatttttgctaatctaagaggttaaaatatacttgtttaatttgtggccctcaattagaagtaaggttgcacatttctcatatttgtatttttcgttttaaaaattcatttttggtatttgcttaatcatggcctttgcctatttttggcattttcttactgatttgtgagagttcttcacatatgtggaagccaggagagagtcagaaatatagatattaggttttctgttacaaacattgcaagtgtttttgtttcttccacgtgacaattttgtttttattttcaaacattgtttatggtatttggtgaggagggatatgagcgttttctcattctgttgggttttacaaagaccgccgtggtattccgtatggaagtgggaaggaaaggcatgagaaagcaattacattagttcagaggaacaaacgaagatgatacctgaactattaatacgttaggaactgcaaagatggagggatctgagccaggagatatttcagaagtagaattggcaaagttttggtattgtcaggactgatttttaccaggtgggacatggagacagagggatgaagtgagcagcacatattccttcctggatcagtaggcactaagtttaccaaggaagcttctccttgatagatctataccactggacactctgggccttgcaaatcccctgagaccaagaagtctgtatctcctctcttgtgatcacagccctgcctttattaccagtggatgaatgaataaattattgttggaggctcttcttctcttcctactaagggataaagactttactctttgttgtagtttatttgaagccccctcaccaggaagacctatggttttaaaaatgaacaagtaggcaggggtatttgctcaaagaaaaaattcacttggacaggcctggcacagtactgatttccctttaaacagcctgggcagccttgtctctaggcaggtgtgggggtgaggtgccaggagaagtgtttgtccttgcaacaagcaaactccagtgacatgttcaatgtcgcactgaaattcctggcaagaggagagaaggcagcctgctctgttcctaaactctggaagattctatctgaaatgaagaaatgctgcccacagcctgtaatggaataaatgaagatctgttaggtaggggctgcagcatgcttggggtctccagtcggtgggcttataggagagatgtcagactaacaaagctgaggtcctgcaagtatctctctggcaccacttagctcaggtgtggattattcaaaacttcactcatggtcccttgaataattcactgcagtagttcttaaccaggggccattttgctaccctctcaccagaggacatttgaccgtatctggacccatttctgcttgtcacaaccgggacagtactactggcatcttctgggtagaggccagggatgcttctaaacatcctacagtgcactgagcagttccacaagaaaagaattttctggcccaaaatgtcaatggtggtgaggctgagaaatcctggtttagtaggcacaagagggatggtgtgaattaatgatatgtctgagttagaggtgcatgcagtatctcccacgcactacaccaggttctttgaataatgacccccgtgcccaagattcttttctctttccctggggtctcatctgggtacagtttggcctctgcgatgctgaggacaggagtgacaacgcagccccaagtggtacgagcccctaggttcacccccagagttctgaccaacattacttgtcctgaaacaggagacatattaaaaagcaagtccatttgtgaagtacagcaagatctttccttgcagacctgagatctaacatttataaacattcatttctgtttgtcagggttcccacgtcatacaccaacccacagtaccactgacgtcagctttgattctggtgatccactcatttctcccagtttgaggctgaatttctgccagaggaggtcagctgcaggaggagacagaaagctggatttttgaaaatctgggagtggataaatatttgatatgtcttggcttgagctggacattctatacctgagagtcagaggaaactaattcagaatctcaattctagggacgctacccttctaaagcagtctggagaaaaggtggaaccaaataaattggcattaaatactgtgcacatctctcaggcaaaatctgatttccctattgtacatagaggtgtatgtatattatatacagatgttaagaatttttttaaaggttgattccagatggaacaagattatatttgattttattaatgtttattcattgatattggcaacattcttttctgtcccgagagaaagagaacgaaccttacaaagtgtaaatattggccctaaattgtcactcataaaggatattaatgcctgtagtctgtttcacgaaccaattttacagaaagagggttttttttcatgtcttgagtctgtttctcagaaatggtcgtggtgggacaggatctggattgacagcggcaaatgagatttgcatggaggcagcgtctccaaccaacagccctgcagaaagttcttagaactccttgttcttaatcccctttggcaggagttgccacctcttccacatgtctctcacttctttcccttcacgttggtctccggatactcctgctttggctgtcttgactgtttctattctagcttgttctctaggacagctccccacttcccttctcctccggtactctctggtactgcaatttcattaattcccaaggcctcaaccaagagactctacagataattctgaaatccctgtctccagcttcaacctctctctgaaccatagacctgctggccaatgagatggaaacatattgagaagcctaaactcgtctcctcccaatattttctcctacttaacaaaggggctatttacctatttattcaaggtttaaaaaatgcaaagtggtgtttgatctatctttatcccacagattaggaaacagttccaagatagcttaaaatgtgtcccttcctggtactggattctttgtgcaatcgggactgccattgtgagtgggagagttgctatatttgcagttgtcattatctctattgtcattattaatcttaatgtgattccaagcaacaacttcccactcttcgatgagagtttaaggttgtcagcaaatgtggaaatattgaggtcctcactttccaccaaatctggttttaacagattagataaatgagctcgccagctcagtctaaatggcaataagtaagctacatgacatcacagtcagaacctccatgcctgggtcagcacctaacacatctattaagaaggcaaagtcagacaaggtattagagagtgactgagagggcagacagggaaggtttcttcagggaggtgaaataggagtgggtgtctgagtggtgaacacagcttcccttcttaatatttcagagtagagtttcaagcctggaggctatcagaggctgggtgaccactagatgaagatgtgcggaggattttggcatccaatagcgatcacagagatgggttttgggggatcctgctcctccagtgattctgagattccatgatgattactgtgccggtgttgagaccaaagtcatgcaaaggctcatgaactagatgctacaattcggtttttgcctctgcctttctgtgcattcactaccctattacttagtcggaagattccccagctctttggtttgagtcattactggcttaatcgaccccatgatgttccaatggctgagtttttcatatgcttgaaacttaccatttcactacactggaaagggaagaaaagtttgggttattcccccatgtgactttcactgacaaaggatacagaagactcttgaaagctgcctctcctgtcagctaaatggagaggctgcctttcagatccttgatttaaagtggcagggactggataacatggttaggtggagtcctcagaggcctcatgatggaaaccaggaagcagaaactgacaggcagacaccccaaacttgagctttgtaaggtctacacaaatagtaaactccagggagtcggtcagcaccttcagaggggctagccttgtgttttctaagcatgacatacctccacgtctttttttctctaccttgttctgaaaaatgcttgatccatttaatgcctcccaagcttcactgtgtttagggaggaatgagaaacaaaaccccagctttaacagctccttatctctcagcctgaaatcatgagagtggggcctatggcccagtatcctgagtagcaggtcagggtgttcttgatgctttcattttgttcctgtgcatctttggtaatgtgttctgttcatctatgcaatgtaccttaaaggcaagaaactcctccagacagagaagcacaagtggaggttgcctatttatccagtcggcgcctggcctacatatttatcgtaatagaatctccagcaaagctgggtgcggtggctcatgcctgtaatcccagcactttgggaggctgaggcgggaggatcacgaggtcaggagatcgagaacatcctggctaacacggtgaaacccgtctcaaaaaaaaaaaaaaattagctgggtgtggttgtgggtgcctgtagtcccagctactcgggaggctgaggcaggagaatggcgtgaacccaggaggcagagcttgcagtgagctgagatcgtgccactgcactccagcctgggcaacagagtgagactccatgtcaaaaaaaaaaaaaaaaaaaaaaagaatctccagcaaactgaccatgaccataatgactctggtggccacagagactaagaacgaagtttgtgctatatcctccaccagtgctcggtctcttatatacattattctcatttaaatgctcaactggtttctgaagccatggtcattgtgcccattttactgtactgatgggaaaattgaggttcagcaagatgcagccagatcctgacttttgaagaagtgagcctcaggttaggggaacagtgagatccatagaacaatgcctgattcttgggcttgctttaatgctgcctctgtggccttgcctggcagtcttgatcactgcgtcaatgtattaccttgaaagtggtgatgtgttttttccaggaatgaggtggtagggcagtagggaagcaatcacctgctctacttccccccagtgcatggaacacatgtgtgtgcacatacccatttatgttccaggtcacataactgagtcaagattaaaccagaacttccatcttagtgagagtttctgtaacaggatcatgcaatatatcttattaaacatctactctgtttcaggccctctgtaagaggttcaagaagctatagatatcttaggattgctaaggagaagctgcagtttttcaggttgacattgtacctatcttcaaccttcatagaagtctttgtttttagacttagcttaaggcttctctttccctctctttttcttttggcattacacaatttttttttatcatgtagtcaaatttatcaatctttcccttaatatttctggattttgatttaaaaaagactttagatacttccaaagttatacaaaattattttctttctaaaattctatttttctgtattttcttctaaaatttcagtggattgggatttctttttgcatttaaaatcttgacccatttggatattatcttggtgtatatagcatgcagtacaatgcatttctggaaaagtccctctttggaatgccccattacacacacacacacacacacacacacacacacacacacacacacacacgctaaatctctgtaacatttagatctatttctgcactttttgatgtttcattagtcaaatggtctgtcaataagccaatcaattatcgaggttttaattattaatgtattgattattgaggttttataatatgtttttaagtgagcaggctttctcatagttttttctatctatttttgctacattattttcccaaaattccttagaatgaatgaaaagctctgttttccttcatctaattgacactgactccttctgaacactcaattaaacaatcttctcctctgaggatgcttccctgatgtcctcaggccttgttacattcccgaagcctggtttgttcccaaagtatcttgcatgcccctctgtcacctgttcatacagtgcaggcttgtgattggttacttttttatgtccccactaagctatggtctccttaaggtcagggacaaagtctgcttcaactgttgttaaagcagattgcacaatgcctggcacatagtaggtgcttgctccagttatctattgctgcatgctaagtcaccagaaccttagtggcataagacagtaatgtatttttcattatgtcttatttttttgatgaaccataactagctcaggtaggtggcttcatttgggggctccttcctgtggttgcataagacagtggctagagctggagttatatataagccagactcctcactcacaagtctggaggttaatgctggctgccacctgggggcctcaactggggctgttagctggaacacctatctctgacctcttcatgtggcttgggcttcctcccagcatagtggctgggctccaagagcaaaagcttttctctttcatgacttgttgtaacttttatgtttagcttcagaagtcacatagaagcctgttctccatactccattggtccagcccatcacaaaggtccacgcaggtcccagaggaggggacataaactccacctcctggtggggagtgacaagatcacattgtaagaacttgtgggataagtggcgtggtcatgaccatctttggaaaatataatctgccacagtgctcaatatgtatttgccagatatttgtaaatgcatgatttaagataaaaaagatggttatattctgggtttagacttgaactaggacttctggctgatcaaaacagatcaggagctggagtgagtgtgcatcctacccccagagcctagctgagtgtgaagtcgagttgcaaggctcctaggaaagttttctcatctcaggagcagtttcaggagctgaagggggatgtgtgcagccatgtcaataaagcattttgagttctttatcataaagttcccatctcccattcaaagtacaggttattagagtttgtttttccttctctactttctaaagtaagtgctttgaagaagatggatgcaggagaaatgacacattaagtatttctgctgaaatgtgggatttctgctcaaatggaagttgctgtgtttatgactggcacacaaattgaagaacggaacttgctttttgaacaattgagtttatcatttttgctctcagaggtacctcttgctaatggagaaagctaaaaaggtttgaaggagctgtcctctttgattctccagataaagataacttggcatatgtctgagaaatgcacaagattaaatgagagaactcccccacctccataaagaccctgttgagtgccaaccagtctgatgggcagtgaagtgcctagcaatgtgggtaggtaagagcttggagagtggggttcgctgctgcccatgtctcaatgacagcatttaattgatccagggcatgtttcttccctgtgggtgactcatttgtaggaagcactttactgaggcagcctttaatgaatgtgtcatttcctctaggacataggttctggatccaggtgttgtggactcaaatcctatttctgccttttactggctctttaccttggaccatataactttacgtcttggtgcctcagttgtgccatctcaataatggggacagtagtagggcctaccttcagaggttgctgtgaggacttaagtgtttagtgccgtgcccagcacacaataaacacttagttaggtattaattttactgttgctcttgtttctgttttaactgtctttattacccatgaactgctcttcccagacctctggacctgcaaaccatatatgtaatttaaaattttctagtagctatatttttaaaaataggaaccaggtgcaattaattctagtagtatattttatttgatctaatatatttcaaatattatttaaatgcataatcattaaaaacttattaatgatacattttacattctttttcttattctgaatttttttgtctttgaaatatggtgtgttccttatagcagagctcagtttgcaccagccacatttcatttttctggttggttgatttatttgctttttttttggggacagtttggctctgttgcccaggctgggtatagtggcacaaaacagtctcagctgactgcaaccttcacctcccaggttcaggtgattctcctgcctcagcctcctgagtagctgggattactggcgtgcaccaccacgcctggctaatttttgtatttttagtagagacggcatttcaccgtgttgaccagactggtcttaagctcctaacctcaagtgatccacccaccttagcctcccacagtgctgggattacaggcatgagccactgtgcccggctgtaccagccacatttcaattgtttaaaatagccccatatggttggtggccacagtataggacagcacagctctggagggcttgttcctataccaataattcagctgcagctgacaagatgcctactggggaaagggatgaactctatctactgtgagctgggtactttacaatcatataatttaatcatgaccatcatgacagcaggtattttgtgcccattttataaatggtttcttcagaaggcatctaatttgatggactagaagtaatttgcccaaagtcacccagctaaacagtggcagaatttgaactcaggtctgtgggactgagatttcttccccatggcaagatactagatgctcgtgataggcagtagatcataagcaccatccagagccgaggcagggctcacacagagccatctgcctactgtgccaagtacctcctgtgtgaccgcatttgaagatagccagctgggctcagtcacagccaaggtgagggctgagtctgggcccagggttagggctcaggataagtctggggcttggagctgtgtctgtgatctgggtcatgactcagcgtgagtctgagggtcgggttgcagtccgtggcccaagtcagggctcaggccgtgcaagggtcagagttgagtctgaccagggtcagggcttgctctgtggtgagacaaaagtttgatctgatgctgatgtcagggctctgccttgggtcaagatatgagtttatcttatgaccaaagggcagagtgcagctagttcataaagggctcatacctttcggtggattctggcagagccagaccccatgctgggcaatgtgtctgtaaatgctgggatgctgtccttcctctgccttgttgcagtagcaagtgacccagcccaccgtgggaaacaatgcaattgcatgtttgggacctcagttgcagtatgggctagagtttgtcatgagtgggaacttatctgaagaacactggggcacaaaatggttgctgactcctctgccatgtccaccctggatgaaacaaggattccagcagctgtactggatcttgcattggtgctgaaatgtggttgaggatggtgaggcagaagatgggatttccttggctctcaggcaaggtaggctaagcttacagggacccagccagtgtggctggaccatggggtccatcagggcattcagggagccaggactcacataccactcactcccaatgactgcgctgacttggtggcatgaccagcttggtgcatgaaggttctgtttgttagaccaagccaagtgccaggcagtgggccacaaaaggtcaccctgtctcgggttatatacatggggtatagccatccagcaaactattattcagctgtagaaatgaatgacaaaccattttcaaataaatcattaagagaaaagcaaggtgggaacaggatgtatagcatgctctctttgacataagaagatataggaataaaaatataaatgccaatgccaacggatgtacaagataccaataaaatgttattattaccttgaggttgtgtaggaggatgctctttatctggatcacatgttgaggtcgaagtccttctctgagtgtggcaaaaagtggaaaatgcaggctctggtggaggagtccccactttgggagctagatgagtcgtaacctactggaagctattttcttgtgatcccttccccacagcaggggtagaaatgtactttgtgaacctgaccataaactgcttgctgtcattagtttcaactgaaatcaaaatggttttgcaagaaacccaaagcagtgaaaaatgatggagctaaacatccttgtattgtagatatttcctttggggtgaaacaggcttgtgtgtgttattattgtggctgccaaagttctgaagcaaactgtttccaaaaagtattgtgcatttataatgcaatttggaggcgcttatgtttttatttgacaggtgcatatttcatgagaacaacattgaacgtgcctttaatcaggatttgtagggaatcgctggtaatccttttatgtttcttctttatatttctattttataaatttgattcactgaacacaccacaaaaattactaaacaactaaaaaggaccgacagtacaagtgagctgagtaagaataccagcaaatgctatatagtgtgtgattgtgttcatgtacatatgtttgtatgtatgtatacatatgtctattcatacatatatatatgtcaatatgttacagacatgttacatattgttacaataaactgtgttggagcacttgacaattaattgggaaaaaataattagaccctcacttctccatggagtaacccaatagatttctattattacataataatcacaaatataaaaactgaaatcataaagcaatctacaggtaaatttatataaaatcttgtacaggagatgattgatttcatagctcattgcctcagtttctttatatgattagataatgatagtgtctaccttataggattgctgtaggaatttaataaacaatgtatgtaaaatcctcagaaaagtgcctggcatgtgggaagtgctatacagtgttaactattatgactgtagctaaacatggtaccaaatagaggaactaaaataaaatgatagatgtaactacataaaatgctagaatttctgaatgtcaaaaaatagcatatacaaaatagagtgcaaatgacacattaaaaattcaacctagatgacagtaaaatattctatatgcatggagttatttcaagtcagtaagaaaaaagagacagacttctcagaggacacatgagtcaatagcctttcaataacaaaagaaaacatctatattaattcattctttctacaaatatttatcatgtatctcttatatcctagactctatctgggatgctgggatagcagtgagcaaatctaaacccctgctgtcaaggaacttactttgtagtggccaataagcacgtggaacaaggagttcagttcacacaggatcaagaaagttaagttaaaataaagggtaaccatttttttccatgtatccacgtagcaaatatttttgagtgactttatcctatattggtgatgatgcaaggaaattagcactcttacacatccctagcaggatgggtaagcaccagtgcagcctgtctgtagggaattttagccaatatgtgctaaaagattttgaaatgtgttattcctacacctccacaacttaactcataggaacttattttgaggaataattagaaatgaatagagagatttctatccaagaacgtgtgctaattaattcattcattcatttacaaatatttattgatcagtcctacacccaggacactgttttaggtcctgggaatacagcaatgataaaagcagacaacgtttctgtttgcggagaattcgtactaaagaatgtgcatttatttgtggggaggagaggaggtctaaatagacaataaacatataaatattaatattgtgaaagtggtatgaagaaaaataaagcatgataaggagagagaggtgttccctggctctccagagggctgaggtggaagaaaaggactcctgttttaggtaagatatcagagaagacctctctgattgactgaaatgtatgcaaaggcctgcatgaagccagggaccatgccgtgctgacatctgggggaggattatcctcacagaggggaaaggaagtgcaaatgccgtgaggtgggaggaccatgtttggtatgttcagggaggaacagggaggccagtggggctggagcaggttcagccatgggaaggccaaagatgagatcaaagagaatagtgggagatcacgtagagatttatgggccattgtgaggattgtggcagcattgagaagactggttgatgcttaaaacaacagccattttatttaatatctcatgattttgtggtcaggaatgtggacagagctcagctgggagattgttccactccatgtagcatcagaagacaggtctcttggtgatattcagctggagaataagttaatatgcagagttcaagatggtttcactcacattgacaccttggcagggatggctggagggctgggctcagccagatcagttaactggcgtgcctgcatatgcactctccaccatggtggtctctagaattgactcaaatctagaattggctggaagacatagtgggagaaataaacttagcagccacatttagtctaccacatggagtaagagagaaagaaaggagtcaaaggggcctagtttatttcaatgtgatttaaaattgtgacaacatagaaataaccaaaatatccaactgagaaaatggctaaatatattatataggtttacattcacataatagaatagatttacatttacataatagaatatttgtgaatgtaaatctgtgtaataagccatttgagaatatcgatgaatgagagaagataatgcatgatatgcctctgtgtgtgtccatgtatgtgtgtgtgtgggggagtgcatgtttgtatttgtgtacccatgaacatagtttttactctttttaaaagctgtaggcactggaaggtcagtgttcagccatgacagtggaaggtcagtgttcagccatgacaaggcccaatgtcatgggccctctgtcatcatcctctgtccgtagtgatccccagacacttttgcatggctgtttagacagaattttcctgcagctcttttgggagtagctcttgaaagtttaacccctgacagttaatgaagaacagtgaggcttaggaggcaggtaggcctttgagcaaataactctgagcaactggttgccattgtcagttctcctaccaagtatgcgtttgatttttaaaaggattccccaaagttctatttaggactacagagtctctaagaatgtatttctgttgtcaaggtcaggagcaagatcatctctgtggacctgtcggtttgaaggagttgcaagatattctcatcattcattgatttatatactcaaaaaacatatatttgcatgtgccaggaaaaggtaaggaaagggagccttcatgtgccagcccctgtgctgagccctggagctgtagagatgagtgaggtggattttttgtctgtaaagagtttgccgatgggaccaagtctgtcatctctctttcctggcctgaccgaggacaagcacttcttagtaaccctgtgaatacctggatgaacgaaatgaacgaatcagtaggagaaccatttggggattaatttggggctcaaatctgtagctcaaatttggattgggaaaaggaagcctgaaatgttccataggtttctctataggtccagttttttgggcgagctctgagaagatcagagttaatttcttccagttcctgcagcttctcttgaccagagcatgcctgactctacaaaacaaaccactaaagggtgatcacagataaccacagttgccagagtttggggagtctctgtgcaaattttgaaaaggtaacctctttttgtgaacagattgcaaaaagatgtccctccctctgaactggctcaacccacgtgagggatagtggcccctaggctaatttaatttcaggcggactcacccccttgacctgtggttttgtgcacaactataggtggcagcccaggtggcttggatttttccagttcgttggtgacctgctgtgatcctgtctctgtccatctgaattctggacagtgtgttccagcctgtgattccacctctagcctcagagcttcgtctggccaaccctgagtttgaggttcattctcttctccccaggggcctccaccccaggccttgcctttgggaccagccctccacaccaagcctgcaggagctccttcacaccccaggaaagggagcctgcagacaagaccaagacaggtgcttccctcctctcttctctccacagaacagaccagattcagatccatctactgggacccaggagggaaagagggctgcgctgacactctccccacaaagccaccattattataatcatcacagcacttagcaagtaacctggagtgctggtttcactggggtgaacaagccagtcaaagccagcattccagccccttttttgttccaagtgccgatttgtttccctgtgctgttgtgcattcatttcagttattcctttagaccagaatttaagttgcttattgatttggcctgtcaattgcccagtaatgctttaggcaggagcccagataagaaagaattccactgcatcttgcagcaccctcccccttcaacctctgagttatttctacctacaattgcgatgttttaaacatctttgcttttaaatattactttccttttcctacttaaaggcaatgcaattttctcttcccaagaactcctttcatagtctcattccatgttttatttccttctctatgcaaactcatttgtcaaaattacacattcagctccttctgtggaagacttagggatggagtaatgtttaaaaaaatgactttgtgacttagaaaaatttcctctcctgtgagtttaagccttttttttttttttttatgcagccaccaattagagagatagtgcaattcaatagatattcattgagcacctgccatgtgtcagctgcttactaggtttggatgcaccaataaacaaaagaaacaaatcgtttccgtcatggtgcttacattttcatgtgggagacagaaaataaccaattagcataataaatgagtagagttcatggtatgctaaaaggtagtaagagaaaacgcagcagagagaatgcagattggaaattcttgcagtagaagtggttaataattttaaagagtaggcctcattgaggaagtgatatattgacaaagacttgaaagagatgagagagatttagtcgcgtggatcatgaagggtggaggaagaagggaggagggaagactttctagtatacggccagccattgcaaaggccctgaggcaggagcatgcttgtaatgttcaaagaacagcaaggaagctagggggcctagagctgagtgtgtgaaggagaaaatgggaggagagtaagtcaggaatgtacctggagacaagaacttgcaagactcggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcgtctcagcccaaaatctcctttagttgataagcaacttcagcaaagtctcaggatacaaaatcaatgggcaaaaatcccaagcattcttatacatcaataacagacaaacagagagccaaatcatgagtgaattcccattcacaattgcttcaaagagaataaaatacctaggaatccaacttacaaaggatgtgaaggacctcttcaaggagaactacaaaccactgctcaatgaaataaaagaggatacaaacaaatggaagaacattccatgctcatggataggaagaatcaatatcgtgaaaatggccatactgcccaaggtaatttacagattcaatgccatccccatcaagctaccaatgactttcctcacagaattggaaaaaactactttaaagttcatatggaaccaaaaaagagcccgcatcaccaagtcaatcctaagccaaaagaacaaagctggaggcatcacgctacctgacttcaaactatactacaaggctacagtaaccaaaacagcatggtactggtaccaaaacagagatatagaccaatggaacagaacagagacctcagcaataatgccatatatctacaactatctgatctttgacaaacctgagaaaaacaagcaatggggaaaggattccctatttaatagatggtgctgggaaaactggctagccatatgtagaaagctgaaactggatcccttccttacacctaatagaaaaattaattcaagatggattaaagacttacatgttagacctaaagccataaaaaccctaggagaaaacctaggcattaccattcaggacataggcatgggcaaggacttcatgactaaaacaccaaaagcaacggcaacaaaagccaaaattgagaaatgggatctaattaaactaaagagcttctgcatagcaaaagaaactaccatcagagtgaacaggcaacctacagaatgggagaaaatttttgtaatctactcatctgacaaaaggctaatatcgagaatttacaatgaactcaaatttacaagaaaaaacaaacaaccccatcaacaagtgggcaaacgatatgaacagacacttcttaaaagaagacatttttgcagccaaaagacatgaaaaaaatgctcatcatcactggccatcagagaaatgcaaatcaaaacctcaatgagataccatctcacaccagttagaatggccatcattaaaaagtcaggaaacaacaggtgctggagaggatgtggagaaataggaacactttttcactgttggtgggactgtaaactagttcaaccattgtggaagacagtgtggtgattcctcagggatctagaactggaaataccatttgacccagccatgccattactgggtatttacccaaaggattataaatcatgctgctataaagacacatgcacacgcatgtttattgcagcactattcacaatagcaaagacttggaaccaacccaaatgtccaacaatgatagactggattaagaaaatgtggcccatatacaccatggaatactatgcagtcataaaaaatgatgagttcatgtcctttgtagggacatggatgaagctggaaaccatcattctcagcaaactctcacaaggacaaaaaaccaaacaccgcatattctcactcataggtgggaattgatcaatgagaacacatggacacaggaaggggaacatcacacaccagggcctgttgtggggtggggggaggggggagggatagcattaaaagatatacctaatgttaaatgacgagttaatgggtgcagcacaccaacatggcacatgtatacatatgtaacaaacgtgcacattgtgcacatgtaccctaaaacttaaagtataataaaaaccgacccccccccaaaaaaaaaaaacttgcaagactcaaaggccattgtaagggcttaggctttggctctgcatgaaatgggaagctgttgcagggttctgaacagagagtaagatgagttgcttgcataagaagaagatcactccagctacagagctgagaatagactgtaggaggcgattgcagatccgagatagggcagatggtgacatctgcaaagggagagctggttgaaatggtttgattctggatatattttaagatccagccaacagatttgctggtggattggtagtggaagtgagaaaaagagaggagtctaggcctgggcaactggaaggatgagattgctgccaagtgagatggggaagaatgtcgatggagcaggtttattggggaagatcagcagttcagtttcaaacatgttaagtttgaaacatttgctggctatctattagacaacatgagacagtggaaaggctttggagttaaacaggccttcattgcaatcacatctgcaccatgattagttctgtgaccctcagaaaaatacttactgtctctgagcctcagcttttatactcttaacatggagataattttctccatttaccctgcactgggagattgagatgaggattaaataatagagtgtgtcctggaagcaaaaggagtgaatccctggttagtgtgcttccagaaaggccagggatcaatcctaatctcaactcgtagactctcctggttgactcgaggtaactccttttcccactctgggcctgttttcccatccctaaaacaagagagttgacacaatcaaccattcagtttgtcttggcattaaggttgcatgagtgtgaggatctcagggtcagatgggctctgccttccagtttgctagcgtcccacctcctaatgggaattcacacacatgtgggtatgcctacacacacacacacacacacacacacacacacacacacacacacacagcctcgctcaggtctgaaggtttttctcttgtttggttagactgggtatgcctgtacacacacacacacacacacacacacacacagccttgctcaggtctgaaggtttttctcttgtttggttagactgcttctccctgagcatgccagtgcctgcatctggccagaccatttttaatttgagacacacacatctccgtgctgttgatctccttcctccctggccggtagtctgggtagccctgaccctctgtggtggccgaactagatggagaaagcagtctaggcagtcaccgttagcccagtttaaccacaatcactgccaagggaatactcccccgacctctttgaagcagtttcattaagagaggagctaaacatccccagtctgcagtatcatcttatttactctgttgcatccaggtcaggagagaaacaacaggtttcactccttccagtgttctcaaacctgcatgcctgggtctccgtctgtgtccccttagcccctcccttggaagagcctgcagcacagcctggtggtcctttcatgctggcttctgcgatgtatccctcccaccaggtttgctcatccgccttgtgcagaggtgtggccaaaactggcacctgcatggccattttgggggagtgaatctttttaatgctagttgatttccttgcaaaccatattatgcttctgtgatccaattttgtaaagagcctgatgtttctttactgttctgttatagcgattgttgacattaacctgacctatctacttttatttttaactgcctctatatactcttccttggtaatggcctgttttcttttcagcttgttaagtctacttgtttctaaaatactgcttgacctgaactttcttgtgtactttattgtcatttttactctccctcattttactccctgacattgtccctgaccattcatttatgatagcatttgccacactgtatcaaaatggactgtcttcctcatctgacggtaaggcaagaattgggtaccagccatctctgtggatgaagcagctagttgaggggcagaaaccccttgggagctcaggggacacttgtagaatgaataaataagtgaagaaattaataaatgaataatcatactaaagaaaagatgattgagaatttacttatgcttttacccaggaaaatgtgtaaacgtattagttcctttgtgtctttctaaaccttagtccaccttataatacacagaagattctgaaagccaggttctttttctgacacagataactcctgggtcagaaaactccagacttgcaagttccagagaactctggggcagaaagccatcccaaccagggcaggcaaagccccagggaactcaagccacagcattttctggcctctggggaaggatggccaattggatattctctgagcttcatcctcctattgtgagagagagttaattgattgactcaccgatgcatcccgtcagtcagcagctgtttacggaacaccagctgcaggccaggcaccgtgctgcaaggcgtagatatgttgctgaacacgactcccttccagatgttcaggatttaacaggcaagtaaacagagggtccagagaaggcactcagcactgcctcatgacatcagggaggattgctcagaggaagtgatgcctaaactgagatgagtcaaaatgaggagagggaagggtggaattgttaatggagagaaagtgcgcccctgccagattatctagggacaaaggcccaggagggagaactcatgcagatgctccaacaggcacttaccccagctggatcgtagtgtaatggatagaggggtaaacaagagctgatttcctagcggtcctgagtctcgacaggttgccacgtcaggagtattgatctttttctggaagcgatggtgaacctctgaagagttttaagcagagaggtgacaggatcagaactgcattttatatgctcactctggctgctgggtagaggagacaaaagtgaaagcagaatggaggaggcaggcggggagggagctgctggggtcatctaggcaacagaagattgtggctggactagtgtggcgagggtgtgggcgctggagaaaagtgggcaggttcaggagatctttagaaggtaacatcgacaggccttggcaatctgttacatcaggggttggcaagcagttttctatgcatcaaatgtggcccactgcctagtgttgtaagttttctcggaacattcacgctacaacggtagagttgagtagagtgaatgttccaataaacagagcctgcaaagcctaaaatgtttactgtctggtcctttacagaaaatatttgtctgcccctgggttaggtgcaaagcactgtgggaagtgaggttacagaaagatttgaggttgccacctagattgtggaggttggtgcgtgttgctgagatggaaacccaggaagtggagaaggggataacccagtctttgcagccatgcctcagcctgccattctaccggtttttaactgagccctgccactttgcctggctggctcttcacagccttctcctctgggaaaatggcccctcttcttccttctctgtccagctgtagctctgctaacacttgacggtccttccaaaaccttgaccttgctttcaccgggccacaggatcacttgctgccccccatcaccttgaccaagggacgggtctcttggctgggacccaccttcctgcgtctttctatgtgtgtgttacccccatctgggactccagaaccggatgcagtcattttatcagctttgcaccagtcggtcctttttccctgtgtattagaccattctcacgctactataaacatactaccagagacagggtaatttataaagaaaagaggtttaattgactcacagttctgcatggctggggaggcctcaggaaacttacaatcatggcagaagatgaaggggaatcaaggcacgtcttacatgatggcatgatggcaggatggcaggagagagagagaacaaacgaggagctgccaaacacttataaacccatcagatctcttgagaactcactatcatgagaacagcaagggggaaactgcccccattatgcaatcaccttccaacaggtccctccctcgacatgtggggattaccattcgagatgagatttgagtggggacacagagccaaaccatatcacctttcttcgcccaacccctacccccaccccagctttgttgctgaagccctagaagcctttctgtccacccgagcctgctccagtgggctgagtagcacctgggctgccactgccctttgttcttcctctccctccctccatcccctggagcaatggtaacttgcagggacattgggtgcactgtctcttttggaggccaggaaacaatccctgctgtctctttctaagcaggtcacctttggtgggtgtgtaaatccacttttctgcttgccaaagtgacattttcatgatacccaaagttattaagtggcatctttggacactttctttttaaccaaagtggagtaggctgggaaatgtcaatagtgataatgtacagttacgtctccaatacccttttgattgaacacatgattgaaatagtgcaaactgcagagccctttgcagggaattgccagttaaagaatttgttcagactcacgggtttttgactgtaaactctgagtgttttaaataaaatactggctgccatggccctccaaccggaaatgtcaaatgctctgcctggctctgcaacccacataggcaggctcaatgcttctccaacttgggagcccaaactgccctcagtcagaagcatagaaagagtctatcttgctgggtgcggtggctcacgcctgtaatcccagcactttgggaggccgaggtggtggatcacgaggtcagtagttcaagaccagcctggccaagatggtgaaaccccgtctctactaaaaatacaaaaaattaaccgggcgtggtggcacgggcctgtaatcccagctactccagaggctgaggcagagaagtgcttaaacctggaggggcggagcatgcagtgagctgagattgcgccactgcactccagcctgggtgacagagtgagactccatctcaaaaaaaaaaaaaaaaagaaagaaagaaagggtccgtcttgccattttgagaccactgtgctgataacggggttgtatcatcccccacataggagaacctgctctgataagtgtggacagaagtttgaatggaaggaaggagggaaagtagggaggcaagcaggatctggtgaaatcagaacttagatcatggggtagtcacccagtcagtgtccttcaattcaaacttgggctacaggctacaatttctcccagtctgagaccaacagatgccagcttattctcaccacaacactgtctaatgccccctctttattgccaaggacaatccctctctggagctcaacagcttgtgtccttccagaaaagctcctatctatggaggaagggtatcttatccagaccatcatgggcagggagttggaggttgggtgggtggggggtggactcatgccactgtggaaggcccctagtggccagggtgcttgccttgcccagtgcaggctgggcttgtgcagccaggggcattcctttgaccttcctgctggcccctccttggctagatgcaccttgtttctcttacttccatcttcctgtgggcaccctgctcactgtacctcctacaccttgttgcccaattcctacaacattaattagttgttaattaattcattctgtaatttgacaaatatttgttgagctaaggtgctggacattgggaataggatggcaaacaaaacagacatgggtcctgctcttatggagcttatattttaatggagacatatatgccaaaaaaaaaaaaggctatcaattgtgtttagatgttaaaaaaaaaaaaaaacaaaaacttatctctagtgttagaggtcaaggtaggcattgccttaggggacttagtaactggaagaggtatgggtgagcttctgggatgcccgagaaggcagagaatgttttattgctccaggtggtgtttacacaggtgtgttcagtttgtgaaagttcatagagattgtgctatgtgcaagttcctggatagataccaaactttgattaaaagctaaacaactaattaaaaagttaattaattgtaatcatgatgagtgctatgaaggagaagaatacagtatgggaatgcatgagaagtggaccttgcctgagaggtgaagggggctttcctgagaaaggtgcattttatatgggctcgaaaggacaagggagagatgttggggccaacaagaatgtgaggagagcattccaggcatgtgccagggccctggagtaaatgagagcatggcctgtgggtggaagctgggggaagacccatgtggccacagcagagaaggtaaggggtgagggttcttggtgggtggtgaggccagagggtggccagcagaggccagggcagggatagttttctttatgcaaagagtaatgggaaaacaatgaaggatgtgctatggtctgaacgtttgtgtccaccccaaagttcatatcttgaaacttaaaccccatggtgatggtattaagaggtgggacctttaggaagcaattatgtcaggaggatcccacccccatgaacgggattagtgcccatgtaaaagaggtttgagggagcccccggcctcttctgccctgtgagcatgcataaagtcaccatctatgaggaacagaccctcgccagacatcatatattctggagtctcagtcttggacttcccagtccccagaactgtgagcaatgaatttctgttgctaataaattaccctgtctatggtatgtggttataacagctcaaacgaatacaggagagcaccaggctctaactcaggtgttaatgagattctcctggctgatatgtgggacacaagctgtggctgccaagaggcgaagtgggaagaccagtgaaggggctggggcattctttccaggggaggtgagggcatggcttggacaagggtgtgggaaactaagatggaaagaagtgaatgactgccccggggcagtgggggttggggtcctcttcctggatcatctaccaaagttgcccctcagccttcttggatagcagtttggcaacatctagtcaagagctctcaaaacagtcacatcctctgatccagtaattccacttctagagatctgttgtaatagaaatctgaactacgtgaacagtttcattcacaagggcacttggattagttttctcttgctgctgtagcaaattaccacaaacgtagtggtttgaaatcatacaaatttattatcttacaattctggagatcagaagtctgaaatgcatcctactgggctaaaattgatgtgttggcaggatgcattctgtagtatctagaggcgaatccatttccttgccttttccagcttctggaagctgtacgcattccttggctcatggcctcttcctcgagcaatgcagcatcttcaactctcttcctcttctctatccttctttcctatttagaaaaatgcagacagaaacaaataagtgtacatgattcaactaccaagtacaataaataggaattattatttccctgtcatcttatttgttcatcattgttcatgctttttacacttgttatgcaaagcgtaatacttttgaaatttgcccagctttctaccaaatattacagcatcagcatgggccatgttctaagagttctttataagcattttaatggcagcacatgcaatgtgtggggagagattatttaaccattttcttctgtggggggcttaggttgttgcagtgctgaacattagggtgggcagaataacccacccccacccccgataaaaaatgtctatgtccgtgttctaatccccagaatctgtgaatatgttgccttacactgcaaaaaaggactttatagattaagttaattaagttaattaaagcaattaagttaaagatcttgtgatgggaagattagcttggattattcaggtgggcccaatgtatcacaagggtctttataaatgaaaaatagagtcaggaggaagaggggaaatcttctctctcctcttcctgtctctttttttccctctccctctcatatttagttgtaggcagaaaagtttagaaaccaatgagataggtgaccaattcaggtaccaagagatataaagatgacaaataatgtgaatttccttggaaaatctttggctacattttctggagacatctaaatgtaggagtaaatggcttattaattatgagcctctcaccttggtaattaagcaataaagacccatcaggcagtgcatttgtgggcgattagatctgtgtttggtggagtcagaaacttgcagctgaagattaagtggttttcactacctgagagatgcattaatcacctggagctcccctggctggtggatttggttgctgatttggaatggcatttacacattaaagtgaggaatatccttatgtgccgaggagagctctggagtgaagggtagttactcagcagggacacggcgggtttccaggtgtgacatcctgactcagtacagcatctgtccaagggtcacctttgtgctactgtcaaggaggtacagatgggagagatgccccagacactgacgacacacactggcgacacacactggctgtcctgccaggtataaggactggatgtccttccaaaggacagagggagccatgtggggtagcagaagcctgtctgctttagagacagacctaaatttatatactagcttcattctttctataaaatgttgggcaagttacttaaaccttctggtcttcagtgtcttcttctgtaacatagacttagtagtttgcaatagtcagctattgctatgtaaggaaccgagcacaaaatatcagtgacatacaacatgaatacacaaataaataaatgaacatttatttagctcataaatgtggctaaatgatgataaacgtcttcttgggggaacttttgagaccttgaacacaagtcatgctaactgagggccaagtgatcttgtgtgaaagaatcaggctaagagccctctgcctctttctgcctggagcatagcatggctctggtgcagagagctctgaatggaacccattctcatttggcatctaggagttctgcctccctgggtgctctcagaaagtgcatggactggtgagggtgaggctggtggagaggagcaggcaggagtgagtttatagacagggtgcagactcaggcatttggctgatattcacgtgatagcaacaatcattagttgattcattacaggccttccagagattctgtggctccccaaattttgtatgacttttatcatttcatgcctttattcaacaattatttattatgcagctactgcgtgcaggactctgtgatgtacactttagatacgaagaagaataaggcaggactgtccctgccctcaaatggcttgcagtctattgggaaaggagacattgagcatctaatttcatagtgaagtatttactcacagtaacttttgactaacatttctgagcctattttatcatctttgaaattggaatcatagtagtctcctcctagggttgtaagggttgggtgagctatgctgtgtaaaatacttagagcagtactggcatggcatgaaagttgaaattatatatatatatatatatatatatatatatttttttttttttttttttttttttttttttttttgagatggagtcttgctctgtcgcccaggctggagtgcagtggcacgatctcggctcactgcaacctccacctcccgggttcaagcgattcttctgctcagcttcccaagtagctgggactacagacatctgctatcactcctggggagtttttgtattttttaatagagacagggttttgccatattggccaggctggtcttgaactcctgacctcgtgatccacccacctcagcctctcaaagttctgggattacaggcatgagccaccgtgcctagccgaaataattcttattcccagatgaatccaggacagttgaagcatcctgggtttagcagctcagacagctctctgtaggccaggagggtcacctctgaccccaagtcccagcttcaacaactggacttcagtttatggaagtttgtttgagttctggcattcagcttttatttgagagccaacccagaggggcatggaagaaattgaatttatttttatgacagttcttagcacagcctggcgatcaatcatatgtcaagatgctgttttgaaaagaagcaggttataggtggacttcggagacctagctccacttacgaagtgagcagtggtaaacacatcacttgttctctctgctcctcaattttctcacctgtaaagtggaggataataataccaacgttggagtatttcactactgggattcagtgaaataataggagtgaaagcccccaacacatgtttgcctggcagccagtaggcattcaagaaacgcaaactcagccgggcgcggtggctcacgcctgtaatcccagcactttgggaggcagaggcaggtagatcacaaggtcaggagttcaaaaccagcttgcccaagatggtgaaacactgtctttactaaaaatacaaaaattagccgggcatggtggtgggtgcatgtaatcccagctactcgggagcctgaggcagggaattgcttgaacccaggaggcggcggttgcagtgagccaagatcgtgtcactgcactccagcctgggtgacagagcaagactccgtctccaaaaaaaaaaaaagcaaaaaaaagcaaacccacacctataatgtctttggtctttgggtgttcaacagatggcattgaattgactatttaagccattttgcctcatcaatactaattaagacagtcagaatcatgagaccaagtgccatgtatcaatgcatacactccaggccaccaggaaaatatatcacaattataaaacaggtctgttgttcaataaatactttgcaactgattaatcatcccctacatctgtgcagtgcttcagagttaatgaagcagttttattctggttggtatagtgaatgttcacaacaaataggtgaggctggcattaactcattggacaaatatttctgaacaccatgaggaatgttgtagctgtgaagcagacaaggcttctgactcaaggaagacttcaatgtggcttgggaaataggcagttctatgagttacttctcttgggtgtgatcgaggaagaaagtgtacagtacctcaccccctggtaatcacaggaagcttcttaatggagataatgtcaaagccaagtcttaaaatgtgactaggagctttacaggtgaagagaagtgcatttgttagggtaggcgtggctgcagtaataaatagacccaaaggcacaatggctcaatacagctattttaaaaatcgttttttttctctctctctctctctcttttatttttttttgtttgagatggagtttcactcttgttgcccaggctggaagtacattggcaccatcttggttcactgcagcctccacctcctgggttcaagtgattctcctgcctcagcctcttgagtagctgggattacaggcacctgccaccatgcccggctaattttttgtatttttagtggagatggggtttcaccatattggccaggctggtctcgaactcctgacatcaggtgatccacctgcctcggcctcccaaagtgctggggttacaggtgtgagccaccacaccctgcctaaaaattattcttaataaacatttacttttggaataaatttagattcatggaaaagttacgaagataatatagagagtccccatctactctttattcagttttaccaaatagtaacaacttacattgccatggcacatttgtgggttactgttaacaccagattttgttgaggtttaatcagttgtgtttttttcctacttacatgctttttctgttccaggatgcaatcaaagatacctcattgcattcagtgtggtatgttggattggcaacaggagcaatagtcctttacttggtcactcggtcacctaggtggacagcagccctgacttacatcctcagtgcatggcttccaagtttgtcctgctcatttccaccccagcaagctgaaagagagaatgtgcctggaggaacacctgcaaggcactttagggcagggcctgggagtcacagccatcacttctgttcccatttcattggtgaaaactagtcttgaggttctgaatcttctgctcagttttgctgtgaacctaaagctcctcttaaaaacgttaaagtcagctggctgcggtgcctgtaatcccagaactttgggtggccaaggcaagaggatcacttgagcccaggagttcaggaccagcctgagcaacaaagggagaacccgtgtctatgaaaaatacaaaaattagctgggcatggtgctgcacacacgtaatcccagctacttgggaggctgaggtggtaggatcacttcagcccgagaggttgaggttgcagtgagccatgattgtaccacagacctccagcctgggtgacagagtgagactctgtctcaaaagagaaaataaataaataaaattgaatctatttttttttaattatactttaagttttagggtacatgtgcacaatgtaaaaaagccttgtcttgaagccacacatagccaacatagggtaggaaatatactctctagctgagtagctgcttcctagctacagccctgtgtgatggaaggtgagagtgaatttgggagagagcaagtcgtctctgccataaggaggatgtaggagtgtatatgaagcagagaaaattgcattaataaaagcagggaggaagggcaagtggtaatattgccctttggaaggcaggaaggttacaggacccagctgggactgcacagctgttaagcagtgctgcaggagctcaaaccccactccctgccccggctcccacaccaatgcgctcatccccttgatccaaaggccttcagacccacaggctgatctgcaggagaagccatagagatgtgtttaatctcataaatttctttaatggcatttttatcagaagttttacaactgtttaatttaaaagttaggcttttccccaaattcgttcattctacctgaaaagagcaagtggtgagagagcttacgagatcctctaagggccctcattgatttgcttttcccaccaggctctgggctgcatctgtgcccagaggctcagtcacagctgggcatgagaaaaacgtgtgtgcatcagaggcagtgtgtctgcctgtcatctcctgtgtgatgctggtgtctgtttatttctggccggatggaatataattgctccctgggctgacagtgacaaatggtggtgtggggagtattcctctgagtggtgggatgcacttgtgcacctaggcggacagaagcaggccctgtcacacagcaacgtggggtttgcttctcagtttgaggcctcccaggcatggagaaagttccaggtgggtgggctgtgagctgccttggggactagtgtctgtgtcttttgagatgtgaagggcagccagggatatttcaggcccccttcttctcgggtgctgtcttcatgtcccagctctaacacgaaggacccggggcgccagaacaccagggcactaattgcagcttgatttacagtggaggactgtctgattcctctgcaaagccatcagaatggaaatacggttgaccctcagtatcctcaggagattggttccggcaccctccttggatactaaaattcttggatgctcaagttcttcatataaaatgaggtcgtatttgcatgtaatttatacacatcctcctgtatactttaaatcatctctaggttacttacaacacccagtgcaatacaaatgctatgtaaatagttgttttactgtatttctttatttgtattattattatttttattttgctttaagttctgagatacatgtgcagaacgtgcaggtttgttacatagatatacatgtgccatggtggtttcctgcacccatcaacccgtcatctaggttttaagcccttcatgcattaggtatttgtcttaatgccttaatgctctcccttcccttgtccccccaacaacctcctgacaggccccagtgtgtgatgttaccctccctgtgtccatgtgttctcattgttcaacccccacttatgagtgaaaacatgcggtgtttggttttctgttcctgtgttagtttgctggtattttactgttgtattgttatttctaattgttttttcttcaaatattttcagtccatgattggttgaatctgcagatgcagaacctgcaaatatggaaggctggcaatagctgtattgggcttttctgctcttattctaaaagtagcccacatcttttgggaaaagtctgggcaatgtggaagagtgaaaggagaaagcaaagttgatcccaaatatttctagccagacctaatcatgttagaattttgctgtttctttctgtgaaggagactaggcggttgctgggtatacagcaaggctacacctctcagcccctttgcagttaggggttaccctgtggttatgttttagtggtatttgggaagaaatgagtcacctccagccctggccctgtaaacaccccacccccactgtttcttccctcttctgatggtgagatacagagggtccagagggggacttcaagactctttgggacagtggagccaccgatagaaggagcctgggcttttcaatgacaaagtgaagcagagccaccctgcagattcatttttgactgtgacacgagcgaaaaagaaatctttcttgtgttaaatctttgaggttactgaggttcacttaccctgaatagaacaccttccaaacacttgccgtgggcatgtgtgtgcacacacgcacatgcacaataatggaatcatatcttgacttattttttgcaacctacttcagtctctcaaaaaggatatgaacagctctccatgataaagacatatttatccaatcaccttaatggctgcatataattccattatatgtatgtaccctactttacttcatgattttcctatttctgggcatttgggttgtttcaggttttaaatttttatgcacttctgttatgaacaggctggtacatatctttgtgtatatatacaaccatttccttgggacatcttcctagaaattgaattacttggccacatttatatggtgtttgatcatcataggaatatcttcttggaaaagaggtattgatttataattctaccaagagcatatgagaggtctaatttcccaaaaccatcaattgtctgaaaactaatctgattagtaaaaaataatagcttgttttaatgtgttattctttgttgattgattatgttgagcaactttttcttgcttattggacctttatattaccagttgctacttctttatgcatttttttctttggggagctttacacatctcttattattttgcaagagccctttgcgtattaaggataatatgtgtttttcgacacattagtagtaaagaataaactaaataaatttatttagtttttaacagatttgtcttctttatactctttttatatagagatgtttttaatttttatttcagtctttcttccttgcttttaaccttattacacttttaggcaaccaaagcaagaatatgaaaagatacttcagattttcttctagcacttttattgttttgttttgttttgccttcgagtttttaatctttctagaatatatttctgtataaaggggatgtaatcatctgactttaatttattctgaaggccaggaagatagaaggagaataaggcatattcaaagcactagaagctgaggatggctggcctgtagccctggaggagatgtttagccctgagcctggagggattgtcagggctgagtgatgagggtgatggactccatgtagaacctgctgagcctcaggtgcctctgggcatcaaaatgtgctgatgaggaacttaagtgtggaatgaattttggtgcttaaatccctggtactggaccatggaataaacgcaggagaaatgaatgcatatttctataaacattcccacataagaatgttggtaatagctttatttgtaatagtctccaaatgaaaacaacccaaatgacatccaaagtagaatggatacattgttgtattgtactgctacagtggaatactatttatcaacagaaagggactggctatctgtacactccataatgtgaattaacctcaaaacttatatgttgaacaaacaaagctggacgcaaacagtatatactgtaggattccatatatatgacattcacaaacaggcaaaactactcatgttgatgaactccaaaacagtggttccctatgggggtgtggcattacctaggttagggaacaagataattctggagggctggaaatgtattctctatattgggttggatgacaggtatgtgaatgtatagaaattcattaggctgtacacttaagatttgtttattttactgaatgcaaattacagctcagaagaaaatagtgggaaaggattaaaatattcaacattagtttacagacgaagcaactgaaacccagaaggtgaggtgactggctctgagttaatgttttagaccaaggctgcctgatttcaacgctggagccaggggagaataaaactgtgatttcctccatcaccaatcggatggaggtacagctagctctaggttccatccctgagagggttttggggggaacaacagccagtatgagggttacagtcaatgaggcagcagtcccaacagaaatctagcacaaatgtggaaactgaggcagaaactccattttatagttttatgctcttcagcggtgcgtgtcagtgtgaactggcagcacctgcttactgggggccaggaacagagttctcctgatccctcactcctttagcacatctagcttggcaaaggcaagcagcatgaccaagtgtggagatcagcattctaagcccacaccctgactccatgaaaaaccagacctggcaagaaccaaacagcagtacacacagttccataactggagaagccatgccaggatctaaatataatctaggagaactttaaacacagcttcacagggacacacctatgggatcatttatgccagttttttccttaagatgtccccaaggcttgcatggggcactgatagtgacagcagagcagtgtcattggtattaaatatgcatcaatgacacttgcaatccagaaacaactcagacccaacacacctccctgctgccttctagagtcccggcccagcctctgcccttggcctcagccctatgcagggacttaggaaaatgggcaatgattgcaggtttgtgctttcctcttgagtttgtggaaggaggctagtaccttctcatggtagcctctaaggaaactggcacagacgtttactgaatcaagagcagttcatctctaaggttatatttccaagggagaaaaagcaattgttacagtccttaaatgtagcaaaggcagacctcatttagaggtgattgctgcatcctagggaccagcagcttttgctgccagacacaagttaaccacagggcgctggtgccaattcagaggcctcctagaccttctgttccccaggaggaagtagcccacagacaggaagagtcattataaaaagaggctgggggtggagagtggagggagcagtgtccctgtgtattctgcttccactgaggaggaatccaggaaagagagagtttcactaaagcccctgggattctagcagcacctagaagtgtttccttccagtggccacattgtgcttgaagcctcctgggtggggtgtgctttatgcgggagccctagtcactgccctcagaaggcttgcagtctgctaaaggacacagcacctccaattacatacaaagagaatccatattgaggaccacatatactagtattcacttaccttggggtcccagctacttgcagagagcattgtgaatgggttagcagtgggaattaaatgaaagggccgtctatagagatgtaccctgaggcaattttgctccctatgagaaattggcaatattcccccagaggacatttttggtcacattttggtcacaacctggcgagtgtgctactggcacacagtgagtagatgccaggaatgctttgaaatatccaacaacacacaagacaagatgaccctccatcacaaacagttgtttggcctcaaataccaatagaactgaggttgagaaatgctgctgtaggagaatgtagccactgtacaaaccatggaaaagcagggagagaatcactgcccaacctcgccatcctcctattctccaatcccatgcctgtacctcctattggctgaatataaccagaagttcgaaaccaagagcccattgaggcaacctgtagaagtcggcttccagaacatcagtcattgatacccttagaggttgagcgaaccagactcaacccagagttcccagtgagcctggtcctcctcagacaacaggatgggtgctcagcaaccctgtgttgttcttttttcatctgtgcttctgccgatgctcttttaatgtttgctgtcaaaatgagggcaggccatggaagtgggagatttctctgggttcagggaagagaaaatgtgcaggatgctgaaagagagctcggtaatgctgctgaaatatggattttcatacagttcaaaaacttctcacctcccacccggcttggatgagaacgtaagaattaaggagctgcaacatttttctagcacaatgaactttaaaaatggaattgctgtgcaaagcaatgactgatatttcagcaaacaggctaagtacaattgcattatggttatttcagctttgacatttctttgcatttagaatagcatcagcagagatgtttggagaccaagttgttcttccttctcagagcccagcttcttcaagtcaggggtcaaagagcatcaatggaagagactataatgtcatgccgtgccctgtagactctagattaatcattccattctcttgctggtcacttactgtccctcctttaatagtaatggcatgcctttagacatcgtgaggcagaaacttggaatgtattagaaatctatcaaatgaacttcttggaaaacaaaagtatggcatagagacaagaaaacaggtttgctgctcacctagtgggtgccaggactctactagctgctttgcgtaagttacatatgttgctaagacgagaagcttcccccatctagccttgcttccctgtaactatggtctctggggccacaaaaagaaaggcgatgaagagaaattccagggtggtttgcagattttcaggtgaatggtataacttggaatccttgtatacatcacagatcaggcagcatggaattaaacattaaatcctgctcaaagggcagaattttgcagaaatttatatagatttaagcctctacaatgttctattccatcagcataatcacccatagttcataataagcactaaggatattattaggactgtggaaagaccgtgcaggaacatctggcctttggcctcattttggggtgtttgtcctcatggagttcacccagaaaactcacacagccttgatggggaccatccagtcgacacatgaaagcttccatcttggtcacagtgtgtccaactccttcacatggagaattctgttcagagtcttagggatgttgatccccaagctggcgtgaatcccaaggatcctatttctggccagctagctttgcatcagccacaagctggcatggagcaacactttaaggtaaatgcacgtggctgtattgtcggtggttacatcagtgcaatattcgtcagaagagtaactctaagccggtactgatgggaatcggaaaatccatgagggtgagttgggtttgagattagtagagttgggtttgagatacccctctgtgccgtgtgagtccattttcttctttatgggtttgtcaagatcagcagtgactgggctaataatacacactcccaccaacagtatatgagattactttttgtggcaattcctcaaagacctaaaaacagaaataccattagacccagcagccccattacgattatactcaaaggaatataaatcattgtattataaacacacatacatgtgtatgttcattgcagcactattcacgatagcaaaaacatggaatcaacctaaatgcccaacaatggtagactggataaagaaaacatggtacatgtaccatacaaaagaatgagatcatgtctttttcagggacgtggatggagctgaaggccattaaacttagaaaactaacgctggaagacaaaaccaaatactgtgtgttgtcacttataagtgggaggtaaatgatgagaacacatggacacatagaggggaacaacacacactggggcctttcagagggtggaaggtgggagaagggagatgatcaggaaaaatatctaaagggtactaggtttaatacctgagtgatgaacaccaggggtctctacaacaaacccccatgacacaagtttatctatataacaaacctgtacttatacccctgaatgtaaaagtttaaaacaaacaccaacagtgacaatactaactacctttcagttaaacaagtaattcattcatttaactgaaagaatatttctatttgtaattgcccaatgggttggccatgggaaaggtctcctgggtcaggggaatggctgttccagccttcctgagaatttcaacattggagctgggctattgggcttatccaggtaaaggaagcaaaggtgaggtacacatttccagtttttctctacataggaaactcaaccattttcttcgtatgtctatttttgcttgatagtttgtttttgtttttacaattttatacaagcaaaagttgctactccacaatgactttctgtccccttgctattgattgtctggatccatttgctcttctactcacctggaaacattaaaaaaatggtgagaagggctaatagtttgacctctggtagcagagttgtctgggctgggctgcccaagggtgtcatgaaaggtggggttatgagtcagttttacttgtattagcagagggatggagattctaggggaattctacctgcccatgacctgtctctggctctgagacctcctgtgatctgggggactactgtgttagttgcagaggccctttttgcagagcaaggggtaggagcagagtagccattctgtacatttagagtgaaacagtggtaagggtttggaggtattcacggagcagactgtctggttgctattgctgtattcctagggtctagaataataactgatatataatgagtacttaatatacatttaaataagtgaatgaaggaatcaatgaatgagttgtggggtgagcccgcaaaacaagcctttgaggtcattgcttaaggcaatacagcctttccatggaagagctgaacttccaaccctaaccatcctgcctctgccacactgggttgccttctgtatgtataggatgttagtctttcccagtagcgaaaagtgtctggcaaagcaaaagtgcaggggagagagacacgcatccctctcactgttattcccttagacatttggctggtggtggtctcagaccctggtgcggagtagctctttctgattgaaggcacatcatgatatgcagcttcctcatgaacattgaatctggctctccctgggcaccagcaatgtcactcagttgaggatgaattgactaagcaataatgttcattgaacttctttaaactaacaacattgtgcaatgtgtttcgtggccaacagccatcattctgcatcctcatagaaagtcacaaagaggacagggctcataccatgcacaggttctggagtgagaaaaatctttgattctaatctgctcttctaagttgtgagaacttctgagagttacttcatgtctctgagctttaatttcttcatctatctattatagatagggatatatatatatatagggatagcgaattgatgctcaaatactcaagtatataaaaattcaagtgatgcagtgatattcttggtttcaggaaggtggggtttccaccgccaatatccacttacttcatgattttaaggaagtcgcttagctcccagcctgagtgttctcatttgtaaatatgagatgttgatattcaccatcctgccctgtctcacaagctaattgcagggttctagtgagatgtaaaagatgagaaggagatggaagaattcagctgcagactcagtcacacttctcttcagttgcaggagagggccatgtgcctcaagtaacttaaggatggaggctgtacatacaattggccaggatgggaaaatattgctgaccctgtgggttttgtgatctgagctaggcaagtccctgcctgaggagatagtgtgaacaaacgcagagagaaagattttcaatagagtctttgtcgcttaatagatgtgtgccttgagagagttacatcacttctctgggcctcagttttatcatcttatctctttccagtcttggcataaatgtcacctcttagaaaggcttttttatattaatcggctttatggtggtaacagaaaaatcctatcattggcttacatgacaaacttgttttttccttgctcacgtccctcctaggtgtgggcttgctggaggcatggctctcgccacatgttttctcattccacaagcaggtgggaggaccagcccttgtctaggacatttcattttcatggtagacgatagacataagagattgagctaagtgacacaggtacattcctttagatgttctgtacagcaatacctgctcatattccatttgtcaaaacaagtcatatggcaaacctcctgtctctggggcaaggaggtctcctcagccagcggggaaggactataagttacgtggcggtgtccgggatgccgggatgcatagtcatcttggagtggaagaaataatggatattgaacaataacacatcctagcacaacttccctgacttccctattgggagttgcagttgcttgctagcaacacctaaactgcctgccgtgattgctgctttatttttctctcgtactcatcatgttctattatcgttctgtatggtttacttatttagtttttaaattttctatctgcacctggccgccctagactgtcagctccatgagggcagggatttttatcagtatttctatgactgtatcctcagaccctgggaaagtagcatgaatactttgagttgattaattaaacaatcttttacatgaagataaacaatggatgatgtaccaagtgcctctctgagcattaaatccttccttccaggcccagagcattctgtacccattagatttccatctgtccccaggagtgtagcagcaatgctctgaattattctgaaggtcacattggagagctggactgtctgtcacctcccacaatctgatctgctgacaagaattcacctgtctctgtagatgaaatactaggataagcaattgggacaggcagctcctactccataacacaatactttcctgaaaaattgcataaaagtcaaatgtctgtgttggaacggttgacttagcttttctttttgtggtagggagtgaggaggtttgcttcaagaaatctaaaaaataataactccccaacttgcctcaccttttacataaaatcttcaaagctctgtttccaacattcaatatatctttaattttgttcttttcattgacacttgagcacaaatttgaccagcttaagtccaataagcatccaattgaaactaaaaatgtaccacttccaatgatgcttaatgatttccatcattgcctcgggtttatgggcctgcacttatcatcaaaaatgcgagtggttccataatttcacttcagttttcagtttttacagaacaataatgactgacaacatgagaaagattttaaatatttattcatcccagcatatttcctgagtacccactaagaggctgttactcttgtaggcaattgggacctgtgctgagcagtgaggacagcctccctgccctcacagagtctgcaagccctttggggatataattgtgtcaatgacattgtgcaaagagatgatgcagccagcatttagctagtggtgggcaaaatttgttatcctgtgatagctctattttaaaaaatccattaatgcacgaagcttaagttttacagaatttttttttaagaatttcagtaggtttgggggtacaagtgctttttggatacacaaagacatacagattagtattatagacattggagtaaaaatattttaaggatgcccctgaatggcatacaagagggagaattgctcagttgaagaaacaaaattcaaggactctctgtaggcaattacggactcttttctcttctcccaagaacgttttttttggtctgaaaatcctgcaaagattatattgccttagatataggtgctctaggatcaaggaacacccaggccttttccttttaccactttctgcggccttggtgacattttctactctgctgtccctgccagaaactttgacatcatcttagatgctaccattcattcaccaaacggttgctcagacccatcagctccaccttagaaatgtcttctgcatccacagttttcccctccatcctgctactgctgcttggtagaaaaaactaagctccatcctggaatactgcaacagcctcctgcttcaggtctcaacccagtcctggctgccccgtgactggataaactctaatctggacatttcaccctcttctctgggttacagaggaaaactgagtgagaacaaaaataaaaaggtgtgtgtaaaagtcacggtgtgggagagaaagtgaaagtgtgggggagagaggtcaagtaaaagtatgtgtaagaaagaaaatgaaagtgcaagagagagaatgtaaaactattaactgtgagaatgaagtaaacatggatataagagagaaggtaaaagtcagtgacagagaaaaagaaaaagtgttgggggaaaggagaaaggaagacagcatgcatgagaggaaaagcaaaaatggcttagagaaaagaaaaatggtcagtaagaaggaaagtaaatgtgagtggaagggggagatagaaggtaaaaatgagagagagtgaaaatgggctgagagaaagtaaatgcatatgtgggagaaagaaaggaaaaatgtgtggagaagaaagactggtgtgtgtttggcacagaatggcacatagtgaggaagaagaaataaatttaaagaactcttttgggaagagattttgtttgagctagcctatcattgaattttatgctacttccaattttccattattataccatttcagagagcattgttgtacatgcgtcattgcaagttcacatgattctttcaggtaaattcctagaagtagagttgccaagtgaaaacttattcacattttgaaattttagatgtagaatagagatatagactaaaaagggccaggctgacctccaaaattgactgtaccgctactcaaggcggttcttattgcccttgcctgccagtacctgagactatttttcattttaatgaataaaaacatcatatatcaaaaatcttattgttttaattttcatttctttgatacccaaagtggaactgttgttcacgcttcctggctacttgtatttcttcttttctaaactacgaatttacttcccttgtacatttttctttggggatactcattagttttctcattgatttgtaagaacagtttatgtattaacagcattaatcttggttggttctatgcatggcaaatattttccaatttagacatgtgcctttgaatgtgttgatggcctaggatcatgagaaaatatgatcctttatgtgattaaatgtatttatttttaatggttttggtttcgatgtattgtaaaaacattttcgtgcaaaaaattttatattcatctaaattgtggtgtcatttttgtttgcttttgtgctacactgagagctttatttcatctagcatttattttgggataagattggatatttttcacacacttaacccattatggcaagactattgaataatgtaacattgttctgctgcattgatcgatctttagattctgaatttttatttatgtttgtgtttgcttctggatgttttgctctgtgcttcatatgtgtcttcagtggcatctgccatctctcttcccaattcaggttaaggaggtattgtttgcctatatctgattcccagggtatctgaaattgctcaggaagctggtttgaaagttattcctttcatgtattccttcatctggtctcatcttcatcatgagtccagcaacaaaccttgaggcttttatgctgttgtaggtttccctatatttattcccttaatagtttctgtgaggaacacagcacctgttgaaaagaattctctagaggttagaaaagaatgatgcacagcaaagttggtgttatagactgatggtaacataagagaagcatccccttcatgtataggtggtaatgaaagtttgagatcagtcagattatccaggaattgctaaatagtagaaagggattaagaatgactggaaccctagggaaaacaaacaagcaaggaatggggaaggtccaggaaaacaaagtactcaaggatgtgggtatagtagtcataccaatgtttatctgggaaaacctaggtaggtgaagggttccagaaggcagggctagtcagccagacccccattcaacaagtaaggccacaggttttctcagagagttcaaggggcagaccgtaagtcaacaagctagaaattgccaatgcataatttgaacttagagattcaaacttctttctatcacagatgtagacacgaacactaaaagctaagcttattacaccagataagcattgactaacacattttgcatagagggaaaatgcacttagtcaaacaaacaaaaaaaatctctgtttagccatccatttcaaatttttatagaaaatagtgtaggcagcatcaattatgcttgggcaaatttagactaattaatgggttgactaagataattattgaaatttgtctatggatgaaaagaggaaagatgaaccatttaaattgctttttgtgtgtgcctgatgactatttctaaaagaatgagcccacggggaagtgtatgaaatgggagtggcccagctctttgcagggtatgatgatagagtaacaaggcagatgttttaatcaatacaccaggattaatgccttaaaacgtctaatatgcataaatccataaaacataccccttatataaagagatatataatttgttgagggtcaacaatgtgcaagaattcttccagatgttttatgtgtttgattacctttcatctatgaaaaacaatgcatgaagaagctatcattaccccaatttatacaccaggcccctgaagcatagagaggttaagtacattacccagttatacacacagtaaggggagaatcgagtccaattccgatgaccacattctgtgccctgtatcttttcaaagaagcctcctttggtggcaatttacttgtggtaatgaggaggccatggctcaaatcagacttagacacactgagaaatgctttcaaaaccaagtgtatgatagatacatagtgcatcatgcttatttcctttcagtgttttctggaagggctttcagttttattccacagatgtaatctgggttttctctttttttccacaggtgtaatcttgagcaatttctaaaacttagatctacctataaaggatgcagcttagccccgcaatgcaataaatgtctgtgccaggagccaaagtggttcctttgtaccagtcggaatttgtgtctaggcaagagataccatgggttaatagggggtaacttggctttggatcaagaatgcaactaggtctgctattcactggttgtgtgttttgaggtgggatatctattctattggattcaactgatagaaactcaactaaaaaaaaaccctaatccaaagaataatttcatggttcatataatttaaaagctcaggggtggcatttgccttatgcctatcttcatttcctccctctctccctctctcccctttcccttcccactcacatcactgcttttctctttgttattttcatttgctagtgagtcccttcaagaaattggaacggtggtctggagatacttctagtctttaatggcaggctctcactgtccttcctgaagtcacatacgtacccctatggcaagaaagttggggaggtgattggcaacctatcaggataacatggaggagagtgacaattcacaaaagcaaggggcgtacagaagacaaagcgatagctattcaatacagagtggtcattctataaatggctctcgtgatttttcaattgcaaattagcccacagtcttcctaaaaattacaaaatctcgagccattcacagttcatgcccattttcaatttgaaacaaacagtctggtctttgtctaagcacttttggcaaagttttgaagtatttattccattaatttttgagatagaaataaatcaaagtagatatctgccctggagattttcttgacccactaccacgattttccacagtagtgttgagatgccctaggtgtgtctgatcaatgggaaataaggcagtgttgtcgcagctggctactagagactgtgcatcacataaaccacaaccttcccctcccattcaccagctgtggcgagggtttgccactgaggggcatgtgtttacacatggctctaagcagatgaataaacaggtgcctcttcacatggatagttctccaagatttatttcatggaggtgagatgaacctgacttttctgttgatctctagtgcaggtagttgagttaatgatgggccacagtttatagcattcaatcacattggtacacaaagcactcctgcttgtttcttttattgagtaaccctcttatctccttcttctctgctcccgtgtccctccccaaccccactgcccacttaatacatttaatttacactgctttgtttgtgttcaggaaaaatttactttgttaatctgagtattttaaacgtacacggataaatcatttatcactcattctacttcaccctttttttttcaatcagtactatttttttaacttccatccagattactgtatgtacatttcacacattacttctaagctttgcatcatagtctacacttttgttatccattaccccgtaatcggtgagcagactgtctccaaatcaccgctactgcctatgatgttctgatacactttcacccagagggccctgtgagaagttctctggactataaattggagttgaatgtctgggtttacattagattagttggactaagtataacagattgttttgcaaaatgcctgcactagtccatgctcccgagctgcaggtgagtttctagagctccccagctctgccctggagtagcactacctagctttcttatttctctgccaacctattcagtgtaaatgactgtacattgtgttcatcttcatttctctgataactaatgagttggagcatcagtccaatgctccttaatattttgccttccctcttctttattgactgttcacataacacctgcgcgtttcttggagaaagggttcctgtgttttctattaaattttcacgagttgcatttatatcctggatattatttggttgtcgatttaagacatcacaagtatcttttcccaatctgtgttctgcttattttactgaatatacatccataatttttagataataaaattcctcagtgctttgatttatgatgtgtgtctttcaagtcttaagtcctccacccttaagtcacaagtatagtcttctatattttctcttaataactttatagtttcagtttttatgttttgttatttgatccatttgaaatctatctttgcatgttttatttttttccatagggtgatccagtatttccaacatatctacaaatctgtccatcacttttttattgatgtgcaatttaacatttattacatgatatatttttatattttcattggcctttctcagagctcattattcaattccactattactgtgccttttgttctgtttcagtattggattgggcaagtcaccatccttcatcttagctagtcatggattgttattctttcttataaattttaagctaagtttatctagttcttataggagtccaattagaatttttacaagattgcattgagtttgtaaattaatttaataataatatagcacatttgttatatcattgtatcctatccaagatcatagaatgcctggatttgttgagttttttcatgtccattaccttatcagattttttaaaaagttgtcttcatataggtcttaggagttcttgattgttgattcttaaacatattatagtttttgttatcatagtatatggtatcttttttaactgtgttttttagttacttattgatggtgtagaaaaatgctattgattttctggagttgatattatatctagctacctagtaaaacttattgattctaatagtttgttgactgtgtggcattctctgtatatatgattgtattatctgcaaataatgacaattatatgtcttcctttctaatatttacacctcattctgatccttttctctttctttgataagcagaacctgggatatagggacctttgtgttttctttaatattaaagggaatatttctacagtttctcaaaaatgtatactatttactataggttttaggtataacctttaacaagttaagaatgttatcttttattcttagtttgctgaaagatttaatcaaaagtagaggttgaactttatcagtcttttatctgtcaattaatgatgtgatttttattctaagactcgacttgcttttctattaataaaaatatttcctcatttgaaaataatgcatctattcccttctgtgactataaagtctctaaataatatatttttttttcattttacagtgtttctatcacatatacatatagaaagtttatgtcactcagactaattaaggaaagagataacttacaaggatatagaaaataattttagtatttcttggtgtccatgttagcaagtttccacttttctgaacttttcacttactgtagagcttcttaggtagcatttttacaagatttttgctaatgtaacatgtaattttctaaataagtgttagagttctgaggctcaaaattcaaaacacacaaaagcgtacacaggcatacctcattttattgtactttgctttattgagctttatagatattgtatgtttttacaaattgaaggtttgtggcaaccctgaatcaagcaagtctataaggcactattttttttaacagcatgtgctaactttatgtctctgtgttacgtttcagtaattctcttaatatttcaaacgttttcattactattagatctatgacagtgatatgtaataagtgatctttgatgttgtaattgtttggggatgcacaaacgttgcctttctagcaatgagcaaacatagtgggtaaatgttgtatgtgttctgactgtccactgaccatccattctcctgtcattctccctctcctgggcccccatattccccgaaacaaaaaaatattgaaattaggccaattaattaccctacgatggcttctaagtgttcaagtgaaaggaagagtcacaggtctctcactttaaatccaaagctagacgtgattaagcttagtgaggaaggcatgctgaaagccaagacagacaggcaccaagctggacctcttacacaaagcagttagttaagttggaaacactgttaaaggaaattaaatatggcctgagaaggactccgtatttctttctctttctttcttgttttttttttctttttttgtctgttgtttgttagaattgaaaacctaactagtagtatgcagctgtaacaatagctaagtcttggccaatcccagtggccgtacttcaaccaatcatacactgctgagtgttcaaactgtgttcaaataatgcatacgccaagctgtaaccaatccagccattctgtacctcaccttcaatttctgtacattatttccccccttttttgtgtataaatcttcttccaccacgtggctgcgctggagtctctgtgaatctgctgtaattctggggtttgcccgatttgtgaatcgttcattgctcaattaaacacctttaaatttaatttggctgaagattttcttttatcagtgcaaatggaaagttcttgaagaaaattaaaagtgctactataatgagcacacaaatacaccaggaatgtttacctatgtatacatgtatttgtatgtattgaaagagatataagaaatattatgtataactatttatagatatagatatttaaactaatatagaaaaaaacacatatacatataaatgtctatctgagatataaacaatatctaaaacaggaaatgaagacacacacttagaaacatacagatgcatttaatttctcctaacttgttgctattcttgtggaccttgttgctaacttctgtgagtgaagatggcctaacagcctatgggagtctttcattgccagctccatgtgacctgccctagggtcaaacccagaatagagatttaaccagacccagcccaagtgccttcaaccaattgtgagagtgctgaccacttctcaaaagattttcaatcaagattggttctcttttattaaacatgtgatgtggatataaatcattgtgtttcagtttgagtaggaagagaagactctttctgggtaggggagtaaagcctaggtttgtttcctcaggataggctggggaattgaaagtgtgggttgagcaaaatggtacctgggaaaaaaagaatctcgccatagtgggtgtgcattgagtgcaaaaagtggcttttggtggcaggcaaatggccgtttgtgtggagggctgcacacactgctgtcagctggctctggctgcttctagctggacttgcagaatcctactagggtggtttgatgaacccctggattaaaaactcctgtttgccaggtaactgagaattgtttcacacatataagaagcatgggaaaaggtgtgtggcttgaccggtactacggaattccaaggtaaaagtccagcagagtttactttgccagcacaggtggatagataagggtatgaccttaacggggcctggtctgaggatccaggcaggtctgaagtggcagaagttaaatgtgcatgggcaagccaggaaggaaaacagagccctgaggcacttggcttggtgtctggccgtatgttccttcacagcactgctagttttctgcccaggccttggatctaaaggcgaagctggggagtgtacagccatagaagacccatgtctgggtcagacacagtggctcacaccagtagcctagcactttggcaggttgaggcaggaggatcactagagctcagaagttcgagaccagcctgggcaacataatgagaccttgtctctcttaagaataaaaatgtttttaaataaaaaaagaagacccatgtctgttattcttaaaagctcaggaatgtatagcttacacaagacttgaatgcaagaccatgtgatcttacttgcttactaggcttttggtgcctgcattctcacataaacagccaggctactctctgtgctctctcctgagagaggagtggaaagtctcccaagtgctgagacaataaatgtcccctctacccaaagtctggcatacagtgggttttcttacatatctgtgatatgctccagacaacaggagtgaaacagtcatattgctgatacatagagagtttgagtggtctagacagaagatcaaaccagccgcagcattcccttaagccaaagcctaatccaaagcaaggtcctaactctcttcaattccataaaggctgagagaggtgaggaagtagcagaagaaaattttagagccagcagagcttggctcatcaggtttaaggaaataagttttcttcataacagaagtgtaaggtgaagcagccaatgcttatgcagaagctgtagcaagttattcagcatgtgtagctaagataattgatgaaggtggctagactaaacagatgatttttagtgtagacaaaagtcttaagttggaagaagatgccatctaggactttcgtagctagagagaaacaaatgtctggcttcaaagcctcaatggacagacttgctctctagtgagggggtaatgcaactggtgactcttgagttgaagactgtgcttatttaccattccaaaaatcctgggactcttaaacactacgctaaatctaccctgcctgtgctctgtaaatggaacaacaaagcctggatgacagcacatttgtttacagcagggtttactgaagattttaagcccactattgagaccaactcctcagaaataaaagatttatttctaaatattactgcccatggacaatgtacatggtaattcaagagctctaatggagatgtacaaaaagattaacgttgttttcatgcctgctaacacaatatccattctacagaccatggatcaagaagtcattttgacttttgggtcttgtttaagaaatacattttgtaaggctacagctgccatagatattgattcctctgatggatatgggcaaaataaatgggaaaccttcaggaaaggattcgccattctagatgccattaaggatattcatgattcatgagaatgtcaagatattaataataacaggagtgtgggagaagttgattctaaccctcacagatgacttcgaggggttcaagacttcaatggaagaagtcgttccacatgtggtggaaatagcaaaataaatagaattagatatgaagcctgaagatatagctgaattgatgcaatctcatgataaaattttaacaaatgaggaattgcttcttatggacaagcaaagaaagtggtttcttgagatggaatcttttattgatgaagatgctgtaaacactggtaaaatgacaacaaaggatttagaaaattatataaagttacttgataaagtagtggcatggtttaagaggattgattctaattttgaaagaagttctacatttgggtaaaaggctgtcaatcaaagagcatctcatgctgcagagtaatcttctgtgaaaggaagagtccattgataccgcaaacttcactgttgttttatttttaaaaactgccacagccactccaacattcagcaaccagcacgctgatcagtcagcagccatcaacatcgagacaagaccctccaccaacaaaaagattacaacttgctgaaggctcagatgatccttagcatttttcagcaacaaagtatttttcagtaagtaatgttcatgtattttagacataattctgttgaacacttaatagactatagtgtacacataacttttatagacctcttgttcagtaccttcttttagtcactgctcaatatatcttggaagtcacttgattacataaagagctttttaaaatggctatgatttcatgatatgaatgaaacttggtggatttaacagtcccctgctaatagatatataagtagtttgcagtcatttgttcttataaacattatttcatgcatgtgtgagtatattagtaggaaaaattcttagaagtagaattctttgtcctaaggtaattgcagatgtaatttccatagatttgttcaattatcttctctacatagattgtgtcacgtctcagctcttacagaattacataacagtgcttgtttcctctacatcctcacaacaaagtatacatttttaacttgtcctgtctaaaatgtgaaaaattgtatctcagtaaaatttcattttatgtgtctggaatttgaccatcttttcaaatgtttatgagtcatttgtattttttttccccctggaaactatctcctgtgccagtttttctgttggcttattaataaataaggtttgttttttattgactgatttgtagtacttctttctatattaggaaaactatgagttatgcttttttcagtttaaagtttttgacatagtatattaattagtctgttcttatgctgctaataaagacctacccaagactgggtaatttataaaggaaagaggcttaatttacttacagttccacatggcttgggagacctcacaatcatggcagaggaagagcaaagacacaacttaccttgtggcaggcaagagagcatgtgcaggggaactgcccctttataaaaccatcagatcttgtgagacttattcacaattacgagaacagcatgggaaaaacctacccccatgattcaattttttcccatcaggtccgtcccatgacacatggggattatgggagctataattcaagaggagatttgggtggggacacagccaaaccgtatcacttagttttacagtaattttagccacacagatttttttaaaattttaattttaaatttaaaattttttaaaattttaaaattttaattcaatatatgttatccatctttccttttatgggttttgtatcacactgggcttccttctctccaagtgtataaataaatagtagcctctcttgttatttttataggttcatcttttccattaaacttttgattatttgctccatctaaagtttacctttgtgtgagctatagttccagctgcattttttttcctatatggctactcagctttatttactagtattagtatttactagtaaatacttatttactatttactagtacactagtactagatactagtgtatctcttttcctactgatttatattccacctttattatatcctaaatccatgctgtaattttgtctacttctaagttttgactgtattcctttgtctactagcatactggaattatacagttttatttactgaaatgtaaagtatgcttgaatatcatagatagctaatctacccccaacacccaccttcaccccatgtaatgctcatcattttcagttgtctaatattgttggttgttcatttttcacataaaatttagaattatcttgttggtgtttttattggcatcacattaaattggaattaacctatggggtgttgacatcacattgtatatttttttatatttttaaaaatctatccaagttctatgtgcgcatagtttaaatcatcaaattgttctttggcatatgataggagcaagtgtagactccaacttctctcacccagttgcaaacacttttcacctggttataattatgcaaaacatatttctgaattagctacctttattggtacttgtgacttttccactgtaccattatctattaatggttttgctttccctgtactccccacccatcactcatacaggcatcccttccacctaccttccccatcctcccgataaagttatatcctaattttggctagatcaacattcaatgtttacactattttgactatgtaaatgctattcaaaactgaaccatgcagtaaattatgattattttcccttcctgcacaactattatgttttccctgaagctaatatttgacttgtttatggtttgtttgcttcatttttatgtttttattactaattcagccccaacactttgccaattatctaaagctctactcaagatattcagatgcttcagttattttttcaatttcatcctcctacagaaagctctcccagagctgctggcttgctctgtgctggtgttgtgctctctctgtgccgtcctctgggatcttcctccactttcactctaccttcaagaagggtattatgctttactcctgctgtattcctgctcctattgccaataactccatcctcacttcttttttttctttttttcctgccttgtcttggaggtgcactttctttagtagcttcctaagaaagtgttcacagcaggtcagcatgtgaagaccttccgtcattgactctcacactcagggaagaatttgactggaaataactttcctttactactttgaaggtgctgttctattacatcccagcatccagtgtgacttttgagaaagctaaagccattctgattcctaagtatgaatttttcccaattccctgtccaaacttgtatgacatgatcagtgtctcatcattataaaattgctccattatctaccttaatgtggattaatttttatccatttatttggttgagcacatggtgggctgtttcactctggaaatactcattcttcacatctagggaattttgttgacctgttttgttggttattctctcccttcattttctctgctttctttttctggaactttagtatttggatgttggaactgttggattggttctgtaatacccacacttttgttattgtccaaatcttcggatgttttgctctgcctttcaagagatttcctcagcttcatcctctaacccttttattggcttctaatatatagtgtcctatttttaatttccaagagctttttattgttttctgaatgttccttggtttctaatattttgttcacagttttgcaatatggtctgttatctctctggggatgttagtaatagtttgtttttttttttaaatgcatgtgggttttttttttagttgtcaacaagtccctccaaattgctttgttctgcttgtttgttttgatctctatctttcatgtttgatgctttctccaggtatctgtgtctgatgagaaatgtgaaacctagactaagacaagtctagtggggagagggcagattagatcacaattaaggacattgataaattgatcatttatttaagcaatgagagatcaagaaagtgatggtttcccattcaagtactaaccaggcccaaccctgcgattaccacaaaaaaaaaaaaaaaaagtgatggtgatcctccacttttgtaattcaccaagatcagaaacacatggtaggagcaacagggttattttcacataattccctggtgattcaatctgcatatttcctaagtctataccctcaagcctaggaaccacagttagtgtgtactcagccccacgcctagtctggagatacagagtcaactattcagcaactactgagtcttactgaataccaagatctgtacttaggctctgaagatccagtattaagaacaacatgatccctgactctgaggtcccattgccaatggaagagactggtaggtgtacacacggtggtccaacagtgctagtgaaataggagtttgtacataaatcaatgtgaaatacctgagggggagaattagtgatagttgcatggattggtgacatttgaacctcttgttggaaaatgaataggagtttgccaaaatgcaacaaagattcaggaggatacattacagtgcacaaacaacatggagaaatgagtgggagtatgaatgtgtccaatgtggagagtgggcaggaagaagttctagctggactggaagtggcagattactattagtgaagcagcctccgtgagtggttagaaagatctccctgcctttgtctaatgcacaacatactcacgatgcataagaggaatgtatgagagcatcaggattccctttggaggtcagttgtctcactgtctctgtactgagcaatgatgttcccaattttggtatagattaatcgccatgtgacttgatgtgtaatatttctgagcggccaattaattctgctaatcacattagtggcaattagcaagatgctcctctgattagggggctgaggtcaagatgcttttacatgcttgtgtttactgaaaaataagttccctctttctaggacctattaatttcttccaacaggggacatgagatttagcccaaagaccccacctgttctctctctctttacctactcctgattcttgtacaaggatgacatctgatactctattagtatgttcggatttcagagaagacttggaaaaggaaccttgagaggggtgtcctgctgagcagcttggaaccttttgttgggaaggcagtgtagagtagggttgcaaggtagacagccctgagttgaatcctggttctagcatttactagctgcatagccttaagcagatgtgtatttgttttgttttttttttcttttttataatctctgtgcctcacctttccacatctgtaagataaagattgtaatagaacttacttaatagggatattatgagaattaaatgtgtcatctgttatatttaaatgttggaatgatatctgacacatagttaatactcaataactatcttcattattactattgattcagagatctattagagaatcaacatatttggagcagcaggatacattggtggtataccttatgctgatgaatcagacctaaactagttgtttagttgtgcgtccatactttgtttcagacgtcagtgaagaataagccattacccgtgaaatctaagcactgcacactgcattgtaagtacatgttgctctgtctgcttttctcgctggaccgtgatgccatgaaaacagggagcacgtctatcctgtctcctgttgcatccccaatacctagtatggagcttgggacatacacagtgctcagtaaagacttgctggattaattgaaagagaactgaacttggaggcaaacagctggttttcaatcctggctctgtgccttactaactgagcaagtcacttaagccaaacctcactttcatcatcagcaaaataaaaacataatttccctttcagtgaaaaaattctgttgaaagatgtcatatgaaagtaaatcagagtagacacacaataagtttgttttctaaatgaataattttatttgaaagaaaatgaagattcagagtcaacacctgacagattataactgcatttattgttattattttacctttataagtgtacaaatcatatatgaatatattcactttgtaaaatttataacatcaggtaatactatgtccatttaaactcgtggctgttctccaccattccagaatactgctcttaacagtgtaatgtatatatttgcaggcttcatccaatgcacttccaacacgtatatatatctgtaaaacctattgtcattttcgagttttttctttgacctaagtgacatttgataatattctaaaacttagggttttttttttccacttgtctctacttcttagagaaattttcaacttagttactacatatttacccaattctttttattacatgatattatctttcacacaagagatatatcatggttattcagtcattagttcatcaatagacatttaggttggttataatatttagcaattgcaaaaaaatgctcttgatagctgtctatctagaagtagtgctttagatataggtcttgccaaattgatctcctcagtggctctaccaacttaaatctctggtttctgccagtgatagaagagtgtctatttcctctatcttttttgacacttaatattacaaaaaaagttttcatttctgccagtctaatgagccaaaaatggcatctcatcttcctaattaatacagaagttgaacatcttctcatgtgttctgataaacactttatgtatgtccttatttaatcttgagacaatccaatgagtaaactgttactgtcttcattttagagatgtgtaatcagtggcccagaacagtcatgacattcccatagcccataaagtgaataatggtaaaatgttcacacacaggaatgcaggtatctcctgacaaatgtgctacggtagagtaaagaagtattagggactgcaggtagaataaaaatcattaataagaaaattggtggtagatagtcttaggtgcaaatgtagagtttccaaattgtcagccatctgccaacgggtacatcatttaatttcttgggaatatcagttatgacttctataaaatcagaaggaaatttctctcatggtgttactgtaaggattaaaggagataatgtatagggcataggcagctttcgagaaatgttaggtgctcttttgaattgaaaaaataaagtcttcctggcacatgggaagctgttgcttatgaaatggttaaaacagagctctgccggggcagggacactcaagtttctgtccctggcagagctctgaggcttctgcttggtgcagcattcgtttctgctttaaacctagtgcaggagattattctttcttccctgagggatggtgaggaataaccagactagccgatcttattgagtcctcataagcttcctattaatagacagggtagttatctgtatatgcagtttatagatgaggtcactgaactcaggatgagaaagtgacttctggcagtacctgcaatctttgtgttgcccctgatctggccaccccaatggccatggaataggctatggatctgcaactccaaaccctgcctgaaccaagcccgcttcaaactttgccctgccacagggaccccagataagtgcactcaacctctttatacagggccctatcactgcagggccattctcaggcattacttggtcccatcaaccattcactcttaactaatctggtgcctccctgaggccatgaggcccttttattccccaaaagttagcactgatggtagcccccacaatagctctatttagccattgcaaaaatgttcttggatagctagctgtctagaagtaatgctttagatataggtcttgccaaatttttctcctaagtggctctaccaacttacatcatatgtattttaacttttattttataggctctggggtagatgggaaggtgtgctatataggtaaactgcatattacagggttggtgtacagattattttaccacccaggtaataagcgtaggaccctataagatagtctttgatcctcaccctcctccctccctctaccctcaagtactccccagtgtctgctgttcctttctttgtgtccctatgtactcatcatttagctccacttatagttgataacatgcattattcagttttctatcctgtgttggttcacttaggataatggcctccagctctattcatgttgctgcaaaggacatgatctcattttttttgtgtgtctgcatatttttgttgagtacttattttgtgccagggactttggtaacagcgccttatttactagctatatatgacttcaggcaggttcattaacctccttttccctctgtttcttatccgcataatagggattaacagcagggctcactttccgtggcgagtgggaagagtcagtgggttagaattcatacattaaacatttagcgcagcactgggtgcattctgagagctcaacaaatacgtaccattgttgatatgctgcttttattcccacagtcaccttatgttgtaggttgatagttggccccattttacagagggagcaatcgagcagagtgatcaagtggcagccagtcagtagataaataggcatccagactgcagagtgaggacaaacatggcttttggcaccagagtcactcatgataatgttgattaagatatggccagtgttgtttggctgcggtctgtagcactctagttttgtatctttttttcttttttgagatggagtctcgctctgtcgcccaggctggagtgcagtggcgtgatctcggctcactgcaagctctgcctcccgggttcacaccattctcctgcctcagcctcctgagtagctgggactacaggcgctcgccaccatgcccggctaaatttttttggtatttttagtagagacggggtttcaccatgttagccaggatgatctcgatctcttgacctcatgatccacccgcctcggcctcccaaagtgctgggattacaggcatgagccaccatgcccagcctagttttgtatcttgatgtctttgtcatgcaagatgctgtccttgtggaaatccacacacactgtctgctggtatctgtttgccaaggattcaaaagcgttctcactgttggacactggtttggtgaaagctcccaatgaaggcaatgtcaggctcaaatgccggatatttcaagtgaacacagcctgtctgatttctttccctcaccctcactggtctacaggaagaaaatgcagacacctgtctgctcatcttttgttttccaagtgggtctggctcaccttctcccgacctgcctccctggccaggtgacctgtcttccttcagtgttcacatggatctctatggaaactgtccatctggacagagagagggcagctgcagagaagaagcattccagagtggtagcgtgtatgagaatggcaggagaggaagcctgcttactggacacctcaatgccacactttatgcacccttcacccccattcccttgcacaacaaccattgacccaatttacagaagtagggactgaggctgagggagggcatgtgcctgcccatatggaagcagtgaagctgcgatgacagcaaatgcgtttatagaattgactgttagccagacctcaaggcatcttgtatttattaaggcatttaattctcactgtcaccctttgaggtaggtactattgtaatcatccctattttagagatgaggaaactgaggcacctagaggttacttgcccaaagttacatagctagtaatggcagagctaaaacaccaacttgagttttttctcttaattgtggtgctcacctgtttaccagataagtgcaaacccaaagcgagaacacactgcccattgtgtgccatcccccacctactcctggtttccaggtaattgattgactgaaagacatcatggttccttgtcagctccatctgtggtcttcagaaagaagatcaagattcctgagagagacggctcactgccgggctgggaaggaccagagttgagacccggcggcacacccgcatttgattacccagtcctgcaaaggaacactgagcttgtggaacagtccagtccaaatgcctctgcttgattttctagaatcaaattaggctggtgaataggccagtagcgatttcatcaatttctcagcctttggcctcctgcaatgctgcccgctgtttactaagcaaatgggcttccagaaccagtcccgctttagtaatgcagcagggcaacctggcggagggaagattacaggtattagaggccatttaggatcatttagaatcgagctgttttccgagcaggcaattaatccagttgcattaaaaggcgctgctggggctcccataactctccctgcattaagagtggggatttgagaggctctgctaaacgacttgcataactagctctggggctcagtggggcatctttattgggggtgtagactgtgggcctctccctcgtgagctgtaggtctgctttgggaagaaaatgtctgtattgaaaggactgggtttatacctggagcccatgactggtcaagcctaagcacctcccagggtcgtgggagagatgttgggggaatggtttcaggtctaaggatatggttgtgacacaaagaagcaaatgcacttcctcagggcctctttagttatttaaggtggaactgccaaggtggaagtactacacaagaccaggaatttgagactaacctgggcaacacagcaagacactatctttaccaaaacattttctttaaaagttaacaagtcatggtggtgcacacctgtggccccagctacttgggaggcttaggcaggaggattgcttgagcccaggaggtcaagactgcagtgaactatgatcatgccactgcactccagcctgggtaatggatttgagaccctgtctcaaaaaaagatggaactggccatagctggatatagcccttttatagaaggatgtgaatggattgctggaggacttctagaatcatgccatgcactgacatcccactttgtgctaagcacttgtgcattccttatatcagcctcacaaacagccctatggggtggggacttcagagatggaagctgaggctcaaagaacctaatgaacttgggacttgaacccatggacccatggcagctgaccttgtgccctaagccacacacttcttccaagggtctgtatccagaaagctctgttgttcttcatccccaagcacgagagagacaaagggtcccacagcactgcctcctctcgtccccatagccttgcctatccccagcccaagttacggccactgactacactacagtgacattgttagtttaagcatctgtctatcccaccaggctcccatgagggcacgctcatcttcccagctccagcagacagacaatagcacggcttctcaaataaaacatgcttggctgagtcccttcccttttctgtatatgtttcccttgcagtaaaatgagagggctggcctccctgctgaggtctgcggtttcctctatctctcatgtgctgtgaagctgcatctgtaagcctgtggaggacagccaacatctatccaaagtagtgactgtctctttagagggacaggtacttcccggagcactgggagtccttgctcctgtacttggttgcttgcacgtggcgttattcttcagcatttatccatagtctgaattccactgacagccacttgttctcaaggttggctataccccaaaatgaaactgttggaggctgcagccaagggcgcctggcagccaggaggcattcagtatgaatttgctaaatgagtgcctgagaatggctgttgacgatttgattaaggcctcgcctaaccagcaccagtgagtcgggcatatctgccatccccaagtaaaaatgataattaataagaaggtaatcaatttatagaaacctcctttctttctcaatttctggtgatgcccttttgcctgttcataaccccttttaactaagtagattgctctttgtctaccccataggtaaatttttaattttctcttatctttactctgttcttctgaatagaaaaggagatagactcattgcaaaatagtaactcattgcaaaacatttcagaacttcacagcccataataaaaaagagtacccctgaagaaaaccaccattggcacttcagtatatattaactccggaaatttcaggttttaagttgccaacttgacaggattacaaagaaagatagcttccaaaccgcaggtgggtcacatctccataccaccaacaggtggcagtaggagttacatttggaaattttagttctaaggatgatgtcgtttgcttctctgttaagcatttcctgtgttttgtattgggttcaaggtgtggaacactgtgctgggcactgtgtcacagggaaggtgctgggccatgtttctccggaaaccactgacatccaatttatcccaggttctagttgaaaaagcaaatacttggccactatcccaccccaccaagtcagaagtagggctcctggatgcacaagtactgcaaagctggatgcctgaatctccccgctctattccctttacctttttcctcaagtgacagcctggggtgatgatggtgggacaaaccaccggatcagaaagaagccttggtccacaggagaagcacatgcaagttcaaaaacataaagaagagaacaagaaaacgtggtactcagaggttgaatttccttttcccacatggatctgattaactcttcttcccataagcctgatcccaaaagccacttcctcttcaaagccttccacggtgtcttcaggctaagctaactgttttagattcaatgctcacgcagcagtttatacctcccccaacacttaacacattatgttgtgattatctgtgtctgtctctgccaccaggatccacactccttatggataggagccacattgcatggtgcctggcatgcagcgggcatgcagtgactgagcaatgaatcgctgggtgacttagagagggttggtaggagtgcttggttggacccactttctgtgaaagaaggtgatctttaaaggctgggctcctttcagagatatgcctcagggcttgctacagtgaaccacttctaatttctcagtgaatctgtggaaactacctcatcggcctatgtacaagccttctcttttctcaagatagatgaaatcaactaatagctagaagcaaggagcaagtccacagtcttataaactcatccaggatcaacacaacccaatgtaacaaaaaggcttgctgtgctctttcaggtaaagaaacggcgagacaagaaagcagggagatggtgggagaaggcgatgagttaaataaatcaatttccattggctcaggtagtaatgtttcaataaaaaggcagttgtatgcccaaaggacaaaaccatcaagtcttttttttcttttttttttttttttttcctctaacaagttgcacaggaataagagttaggtcttttgatattttaaaatttactttgaggccaggcgtagtggctcacccctgtaatcccagcactttgggagactgaggacagtggatcacctaaggtcagaagttcgagaccagcctggccaactggaaaaacctcatctctactaaaaatacgaaaaattagccgggcatggtggcacatgcttgtagtctcagctactcgggaggctggggcaggagaatcgcttgaacctgggaggtggaagttgccgtgagctgagatcatgccagtgtactccagccggggcagcagagtgagactccatctccaaaaaaataaaataaaattgactttgtgcaaggcgcctagagagtgttttcagacttgatgatacctgttatcagcagttggctcctccttctcccattcttccatccatatctgatgatccaacaaggtcatccttgtttcacatgtgtcaaacccggctcattagacagtcgtggtatcacggtgcccttccccgtactattcactgggacttttaaacctcagataccttttattacctttaccaagcggatttttaaactaacatctttttgaactcagaaattatattccctacaccatttttgaggatcttcgaagtcctatgcaccatgcgtgacatcttataggtgaggaagctgaatcagggttatgtagtgaaacttgagcacgttaatttaaaatttaaaaggtcgtttctgtttcatattgaggttttaaaattctccaacttttcacaagagctagttctcgcaggaagcatacaatggttcaaaaagatacttgtgacaaactgatagttgacacggtcatagagagcgagttgtatgaacaaaaagtcaggacacaaagtctgacaggtgagatgcactttctagcagcaaaggcttaatctattttaaaaatgaaactatcccggaaaaatccaggatatatggccacagtcctggaatgttttgagatagagatatctaagattaagcaagcataaaatgcaattgattttatgtcttagtatttatatttcagggatttaagctgtaacactgtgaggattcagataatgaaccgtttttagtaacttttttcagagtttgcccttaattgtcgtaaggactacttatagcattggttatcctgaggctgacacttggaattgtatgtaacatacacatgattcatcagagacccagacccaagatattccaggcagggcatcaggagtggaagggggacaaacatttccttaacttcagaaaagtaggtttgaaattaagagctttgtctttaacatgaaatattgaactattcatttatccattcattatccatttattagatgaatggataatgaatggatattcatttatccattcatctaaccacacatacttattgaacatctagtatacgccagacactgtgagcagtattgggacataaagacataaagtggacataaagacagggaaatctggtgctattagatggtatatggcagggctgttcggcctgtgaaagctacccaaataaatgaaatttgagctgagttctgaagggtgggtaagcatgaaaaggcaaaatgtgagagaaagatcttctaggcagaaggaactaaatatgcaaacacccgagagctggaagaagcataacatgttccaggaacaataagaaggccagtttggaaaatggttcaaatttagaagggccgacaggagccagatcatgggcctatgaggccatgctgaggatttcatccttggcctatgaacagtggaaaactgttgaaggattttaaacaagagagtggcatagttttgcattttaaaagattctatattctactaactagaacttggaatttattttttccttagaaataacttaataaatggtagttctatggagccagaataatgctattaacacaatgcatccagctaaactgcctattggaaagctggtcttggttgccaaataccacttacaacttggttcctataagaaaattcattccaaattccagacaacctaattacaaatgacattttcagggacagcctacaatctacttaggcttgtgaaaagcctccaacatttttccatatcaaaggttgttaagaaaggtgaggaacagacttctgattttgagatagcaaagacccttctgctccttctgctttttttccccttctccataagaagaaaaatcagaaaaggaaatgcaagtgctgtggtaaaactaggaagaatatattatgttggaaaataatgatgaggaaaggtggcaggttgcagtgtgtacattaagggtgtggtcagatgctgagagatgacatctgtggctgcagaccttaaacaaagtcagcatatctgcaagactgacagtgtaccataagccaataatcccttcgatgtcaatttcagggataaagcacataggatgggacaattcctgggtacagtttggcaccatggagaatcaaggaaggaaacactgaataaagaaccaagaagtcggccgggcacggtggctcacacctgtaatcccagcactttgggaggccgaggcaggcggatcacgaggtcaggagatagagaccatcctggctaacacggtgaaaccccgtctctactaaaaatacaaaaaattagctggacatagtggcaggcgcctgtagtcccagtcacttgggaggctgaggcaggagaatggcgtgaacccgggaggaggagcttgcagtgagctgagatcgtgccactgcactccagcctgggcggcagagcgagactccatctcaaaaaaaaaaaaaaaaaaaaaaaaagaaaaaagaaccaagaagtcagtctcttagaacggtagagtagaagagacttaatcctatgacattaatctttgctggctaaaataagcaatgtacacaaccaatgctatgtaccataaggaatgttactataaactggagagaatttctgctatcttagaacttggccctgctccacgtcaaataaaaccttctacaaatagctgattcaagtaggactcaactcaatcagagattggtaataacagttattttagagataccagaacagattctacacaaaaacttataatacaatcatggaaaagcataggaaaaagacaagttaaaaaaagaacacttgccagaaagtgttgtcacagataaaaactgggaccaaatttatcactactaattttaaaagaaaattaagcaattatcttttctaccaaaaatatgtcacagagaagtatcaagcagaggataaagtatgatcttgcttccattaggagtgaagtagaatagcaaaataaagtcatcacagaaacaaaggggccatattggaagcatcacaaagaagaatgagcacttctgaaaacattaaaggcatgaacaacaatgaggaaaaggaaatggaaatcagtaaaacgttagaaagcattagagagaaaatgataaacatggaagacaaaggagtctaacatacacatatgtggtggccccaaagaaaacactgaagaatgataagagaaaaaatccagatagaacacaagaatttgctgcagaaattaagagagtcttaaacctaaagaaggaaatatcacattgtgttctggggaaacactctttagaatattcaaaacaaggatatatcaagtaaaattaatggactttaaatctaaacaaagaattatttggtgtacaagcaaacatatcaatggcctacaaaattaaaaaaaaaaacactctccatagtaacattaaatgctaaatgacagtagaataatatctgtaaatatttcagagaaataaagtttgaccctgaaaatctgcaaccagcaaaattgccattcacatataagtacaggagatggacaatataaacacacaatttcaggaatatggtccccattaatgtttattgttaaattattagaagataaactctagccaacaacagatagattccgtgttctctgcctagtctttttgctgtagcttctacattcataaaaatcacaactcttcatattatagagactcgaagaggtaatcagagaaatttgaagagataattagggaaatggaaatgtggaaattacccaacttactttcactatggccaatattgaaaaccgtgtatcctaaaaaaatccttctgtaacaattacgtatatgttgggagaggacgagtgtgtgtttttaagtgaatgactatgcttgtgaaattaagggaaatatccaggggacaaaagtgaaaagagagctgagaatagagttgtaagtgaatatacagcactgcctgccctaggaaaatttctcaataaaaagaaccttgagtttcagttttattaaggggagttagaacaaaggctccaccctgaataaagcttatgtacttgaaatcatataccctcagtgaatgaccaaatatggaaaaaatatttaaaacatttacagaaataaaagatgagccgggaacaatgacttacacctgtaatcctagcacttcgggaggctgaggcaggaagatcacttgaattcaggctggagaccagcctgggcaacatagggagacctcctctctacaaaaataaaaattaaaaaattagccagctgtggtggtgtgctcatatagtcccagcgggaggctgaggtggaagaatagcttgggcccgggaggtacaggctgcggtgatcagtaatcttaccactgcactccagggaacagagcaaaaccctgtctcaaaatgcatgaataatgggataatggattgagaacaccaaatgttgaggaggcatatttttaaaagaatcaaatataatttagataggaaatgacaaactcagcagacatattatgaaggaaatgagacatacaggagaagagaattaatgaattggttggaggctagaacttaataccctcattgtagccaagaagagagagagagaaaaaaaaggaaaacatgaagggaataaagaaacatgttagtgggatgagagtctcacatatgtattctgtaagtagaaactgaaggaagggacaatattcaaagtgagatgaccaagtactttctagaactgatgacagacaccaattctcagtttcaaaaagccagtttatcctaagcgggataaataagaaagaatcaaaagacacttagatttattacaggaaatttcatagcaacagaaaggtcttcaaagaggctgaaaatgtatacagatcacttgccatggaatgactaactcaaagcaggtttctcaacagcagcaatgaaagccagaaaacagcgaaaaatccgcaaaatgaagagagaaggaaagaaacaaaccttaaattgcatacatggttgatagtatgggtaagagaaaggtattgtaataaacaaaacctaagagtaaattgccaataaaatctcataggaaagtcaaagcattttagctgaggaaagggaaaatcaatctctttccccagaaaggaagaaaagcctactatgcaaaaatcagtggtgagcaaggaaattggtaagcagaatgggaaatctaaataaacactgactatataaaaaatagtaaagttcaagttggtatatgtgtgtgtagaaaacatgatacaactaaactattggtcaaccataacatgtaaactgagagggagtttctatttaatgtattccaagatctttggattgctgtggaagtgatgtattgatactacttagacttcaactgagatgtgtgcaattttttttttagagatagggtctccctattttgcccaggttagaatgcagtgactattcacaggtgtgaacatagcacactacagccttcaactcctgagctcaagtgatcctcctgcctcaacctcctgaatagctagaactgtaggcacatgtcactgtgcctggctacaattttaactaaaagatgcagatatatatatattaatttctgaaacaggagagggaaaaaatggaattaaagagagggtaaaaaatgtttagaaatttaaacatgaagtaaaaatatagaataagttgaaaaactaatatcaaacttatcaataactacaatatatgtctacgtcattgtactaaacttaccaatcaaaggagacattgtcagattaagttgttgaaagaaaagaaaatgcaattggctggaaaatgacactggtgacttagtttttaaattttccaaattccctcacacaaacaaactgaaacagcaaaacaaaaccccatgaacaatatttacaaaacacctaggaggcaagttatccctataaattacaaataatgagtagagagggtcaaactattgacaatcaggttgtccaacaatgagacattcaaataaaatttctggactttaaaagaaaaatgaattctgtgttcattcaaggcaaaactaaatcacttgtcaaggaaagacgatcaaattattatgagactgacagctacaagatctgcatggtgtcaggactactcagggagaaggagaggaaagtaataaggcatcgtatgggcttcagagtcacacataactaacaggtacttcctggaaagctcaaacatcaaatttgagaattgtagctaaaactgtgaaggatcttgcaattttcagtagaggataaaaacaaggggtcaacagtaagaccttatgtgtctggagtagtctaggccctgtggactctcagaaggaaccagtcaaaattcccttccaggaataaacaatgaaattaaggatctaaattgagtagcacagagacaacagtgacaagaaattgaagatctgcgagtatcagaaaatgagccaccatattcgtgcataccatatacaggagaaaagagagctctgtgagtttagaaatgaaattttggactatattctcttctaaatgctcagggaaaccaatttcatataaatgggaagacagaagataatcgaaataaaaacacatgcaaagttagtgtcaagaaaaagaaagccgggcatggtggctcatacctgtaataccagcacttcgggaggccaaggtgggcagataatttgaggtcagggtttgagaccagactgaccaacatggtgaaaccccatctctacaaaaagtagaaaaacttagctgggtgtggtggcacacacctatagtcccagctactcaggaggctgaggcaggagaattgcttgaacctgggaggcggaggttgcagtaagctgaacttgcaccactgctctccagcctgagcaatagagtgagtgagactccatctcaaagaaaaaggagaataacacccctccagaaaatcaaagtttgccaaataaatgtgcctacgagtcagatgagaactatttcagaaagcgttaaagacattaagaaaatgatatgagacacaacaacaaaaatcagaattagaaaactcagaatgtagtcataggactcaggaaataaattataaatttaagaaaatatatctaagaaatggagactaaggtagaagtcacacacgaataaattcacacaaccactagtgcctggagaaaactaagttaaagaaggaaacttttacaaaagcaagaggcaactagatccaagagaaaaggaaaaagttacaagacaggctaagaaaatcattatactggaattcccaaagaagaaacccaaagcaaaggcacaaatatcaaaaagtaaaatttaagaaaaagttcttgttgtactatttctttttctgaaataacttcaataattacttattgaaagggcggtcatacctacttgagaacaccaacctggattgccaacactgagccatgttttagtaaaatttttggacctcaaaagaaaataattctttcatgcttccaggaaaaacgactaagtcatacaaaaaggaaagaaaaccagaatgttatcagtcttttggcagcaatgctttgtgccagaataaaataaagtgatatatttattatactcaagtaaaaaaatgtaaaccaagcactttatatacagcaagactgactttcaagcattaaaaactgcaaattgctatcaacatgcaggaaatcagataatattgttctaatgggttcttcctgaataatctactcaatgagtttcagtcaaccaacatgattagagagatatcagcataaaggctactggtgaacattaaataaatattctatggaaaaaagtacagtattgaatggctatatgctctgacaacataaattcagcacacctattaaagatgcaggaatattggaaaaggatctataaatcaatttattgttttaataatcaaataaatggacgtagtattgaaattacttctgtcattctgagactgttaggtgtacaacatagaaagcatgacattctaatttctattttacccttatctccgtgagaaccaggattcttggtgaagaagaaaggcaatacatttgtaagataggagaacttgtagtcctaaatttaaatcgtaagtttttatatgagcttaaggggtattttatcttgaactcatatgaaatggccaaaatcttggtaaagcatgaatgaaatttgttgaactggaatcagaaatatcagaatggatagacaggtgagtaggtaggtaggtaggtaggtcactaggtaggttagataggtagatacacatagagagagatatgtatgtatgtatataggtaggtgggtgggtggatggatggatggatggattagataggtagatgatagatagatagacagacagacagatagtcacatatgtatgtaggttggtgggtggacggatagatagatgataggtagatagataaatagatatgggtttgtgtttaggcatgagttactatctatctatctatctatctatctatctatctatctatctatctacacacacacccatacatacatatatatatatatatatatgtctttccaagctctgtctgctgacaagccctggaaagaatgatatcctagtaacaatgaacacaactagcatgcagatcttggtttctaaataccatctcccataaaaggaactaggcatccttagataaatagttcatctcagagctggggcagagaaaatacaagatgaagttagagtaagcatgtagatgcaatgaccctgtattttaacaaataaattgcactgggaaaattggagagtagtaggctggagacaggactgatagactagaagagactgaaggcattgtctttaaaaatatacaaccaaaacagaaaaatctaagccgtggtgcctggggatgtgtatttggaagacaaaactataaataaaagaagaaaggggttattataaaagtcatgatactggttactttgaggggccgaaaagggtatgttactgggacggggattccatgatggccagcaaattgtatttgttgacttgagtgctgatgtcgagactatttgcttcataaatattcattaagctctatatttgtcctattctgttttctatagttatactatattttacaatagaaagttttatttcattttttaagctgcatgttccttaagagacacatcgccaatataagtattcaaaaagacaggaagtaaaaaagttgagaagtttcatacaatatttttgaatagaataagatactctgggcaaaactaacaaaaagagagttggtgtagttataataatatcagacaaaacagagcttaaggcaaaaaaaattattatgaaaaaatgaagctatgtgatgaaaggataaattcactagtcaggtacaataattctaaatttgtatgtaccaaataaagcaggttaaaacatatgaaataaaacttgattatactaggaggaaaaattttcaaatgacacatcatagtgggagattttacacatctcagtaatttgtaaaccaagcatataaaccacaatgaggagttaaaagatttaacaaaattaataaaatctttaaaaaattaaagaattctatgtttggacgtcagaatacatattcttcccaagtacacatggatgcataaaattgatcaaataaggactcaattaattcaaaacatgaatacacacaaacacacatcaatatctatatctgtctgtctatctggaaagacagaagaaataagtcaacaacaaaaatatagccctattaaatgtagattagtaattttttaattccaaacaaccactcctgggtcaacaaagacatcataataaattaaaatctacttgcctactctaaataaagctactatatattttgtgtaagcagtgtttatgcagaagcttgcatgtgagtgttcattgcaccttcatacgtaacaacctcaaaactagaaacaagacagatgtcccttgggtgaatagttaaacaaattggtacctgcacaccattgattactactcagcaatacaaaggaatacatacaaaaacctgggtgaatcttcagagaattaggctaagtggaaaactctaatcccaaaaggtttcatgctgtatgattctatttatataacattcttgaaacaataatttaaaaaaactggagaacagattagtggctgccaatgttaagaaggagttgcggaacaaaaagaagtgaatgtggctatgaagggcagcatgagggagccttctggtgctggagatgttctgtgtcttgactgtataaacatgaagaactcgatcaggacattgcaccatagttttggaagatgttaaaatgggggaaactggataaagggtacatgagagctttatatattatttctcacaacagcatgtacatctacagttacctcaaaataaaatttcagggaaaataaataaaatactgtacattaaaacacagggtatagtgaaagcaagatttattttctttaatccttattttttaaaaggctgaaaattattaagctagtttttcaagctaataaaccagaaaaagaaactattttatagattcaaagacagtaaaataatggaaattattaacataagaacaaaaattaatggaacagaaaaaatcccagaagatcaacaaagccaaaaggaagaaagacaatacacatactcacgcacgtgcgcacacacaaagaattaaggggaattatagttagtctacagatatggcacaatttaaaataggagaatactattgattaccatattctaatgcatttaaaaatttatgtgaaatggataactttcaagaaaaataaaatactatcactaacacaaaaaggaatacctaaattctgttaactgtgaccatgaaagaaatccagacagtaaaatcttgacagcaatctaatagaaaacacaaaacagggtggtagaaatatatctaaaacaaagatacaaaattatctgagaagagaccaaagttgtctcctagatttaaaaaaaaatccagttttatgctgtttataggagtcacaacttaaaacataaaatcatggaaaggttacagataaattagaggaaaagggacactaggaaacactattaaaatgacagtttgcattaccagagataaatataaccattaatataccgacaaaagtcaaattcatcctgaagatataaccacctctaaactgagtatgacagtattaacatgcctttaaaaattcaaagcaaatgttagaacatcaaggagaatgtgacaaatacattataattataagcaatattaatatattctctctcagtaagtaacattttaatcaggagaatatatactatcaggatgacgatttgaacaatttcaaagtgttcaatgactagaaaccacatattcattccaagcatacatgagaattcataaaaattgaccatttgttaggaatgaatcctcaactcaatctgttatcacacagactacattccttgtttataattaacataaaatcaataaaaagtaactttattttaaaatctgtgtgtggacttaaatctctcctaaattactctggagtcaaaggagaaatcacagtgaaaattggaaaatatgtagaacttaatgataatgaaactattatatgtcaaaatgtgtgaaatgcagttaaagcagtatttagggagaagtttaagccataaatgtttatgttagcaaagatgtaaagttgaaaattaatggactatgcatcacacttcaaagttagaataaacaaagaacacagaaaggaagaaataattaaggtagaaacagaaattaattaaatggaatgcatatgtacaatagaaagattggcaaagtcaaagttaattccataataaaagctaaaataattgataaacctctgccaaggtaaaatgaaaaaaagagagaaggtacaaataagccatattatatgtgaaaaaatacgattataaatgcatcagtgatgtaaaagataatattataatctctatgctaattaccctaaagaattaacctgaaatgagtgaattgtagaaaaatattaaaacttagtgaaaaaaaaatctgagcagtcctgtaatctttaaaggattactttataatctgtcaacaatctccccaaaatgaaaacatcaggtacaaatgatttaataggcaagttttaccaaacatttgaggaaaaggaaattctaatcttacataaaatcttacaaaaaagaaatgaaactttctctgattaattatacttagtaaacataaactttgtgccaaaagtagataaggacagcatgagaaaggaaattatagctttattttcttatgcacattcagaaaccaaagttagttagcaatttattagcaaaaaaattgcaagagccaggtttatgcaaagaaaaacatgatgactaaggcgaattcattctcagaatgctagcttattatgtagataaaatcttagaattcatatgagaatttgccaatgtttctataataagaaatattaaaatgtcaaattacaggctgtatttcgtattggaattcttatctactacaagtgaatcttggtacaaccactttggaaaaccagaagcgtatggcaggatctacaaaaactaagtatatgcttaaccattaattctacttctaagtacaaatgagcagacatgaacacctaagtatgtaaaaagatgagcccatgaatgttcatactagccatatcccccaaatgtaaactgtttaaaaatctaccaacattaatgtgcataagttatagtctagtcatgtaatataaacctatacagcaaagagaatgaacaagctgtagccatattcaacatgatgtatctcacaaaaacaagggggaaaagctagtcataaatgaatacattctctgtcattccataagtgtccaaaagatggacagctaatatgtggtaaaagggatgaacatagtggttatctttatgaggggaagtcactggttaagatggttctcatatcatggtgatgtgttcattctttttttttttaatttatttttttattatactttaagttttagggtacatgtgcacactgtgcaggttagttacatatgtatacatgtgccatgctggtgtgctgcacccactaactcgtcatctagccttaggtgtatctcccaatgctatccctcccccctccccccaccccacaacagtccccagagtgtgatattccccctcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggcaaagatgtgttcattcttgatctgggtgctggttacatggaccacgctgtttgaaaatttaaaaaactgtacacttatgacttgtgcacatttttgatctattgtacttcaataaaaagcttattcaagaaagtcattgcatttctgtaccccagctgcaaacagaaaaagtattaaaaatgataataagtataatagcaaaatataacttcctagggctgaacaacactcgtccatgttttttgttttttgtttttaatggagtcttgctctgtcactcaggctggagtgtagtggcccagtctcagctcactgcaaccacaccctcctgagttcaagcaattctcctgcctcagcctcccgagtaactgggattacgggcacatgccaccacacctgactaatttttgtaattttagtagagatggggtttcaccatgttggccaggctggtctcaaactcctgaccttgtgatccgcctgcctcggcctcccagagtgctgggattacaggcatgagccaccatgcccaaacttgtccatggttcttatgaaaaaaaattataaaattgcattgaaaagttttaaacgtgacctaaatagagagatagattattggataaaaatacccagtgtgtttaagatgttgattattctcaagctaatctatagatccgatggcaattaagataaaacccccagtggaacttgacaagagagttctctgatttttacagaagaggatatccaaaagagaaaatcatgaagattgctgccctcccggtaatgaggtcatactataagttacagaaattaagagaatgtgaagttagtacagggatttacaagtagagcaggatgaaaagtcagaaataggcctatacatatgtggaacggttttgtaaattgttatgacaacaatcctacatagcgatagaataattgattttccacttggaaaaattgctgggatcctatcactcactatgcacagaatcaatttttgatgaataaatgtcttatttataaaaggtaaaccttcatattaagagaaaaatatagacagaatactttttgactgtgaggtagagtcttcttaaagattatacaaatagtaatgttaatcaaatgtgttaaaacgttgaatttctcttcttcaaaaggcacccccaaatcaattgaaaagacaaaccacacactggcagaaaatatttgcaacatacaaagccagcaacaaataagtatctagagtaaatcatgaatctcagtgaatcaattttaaaaaggcatttgaaaagaaaagaaaagcgtgaacaaagaaaatgcattttataaagttggatgatcacaaagaactgagaaattgtattaaaatcttagaaacagatattaaaagtactaggtgatatgacttcatatcccatatgtaagaaatgtttaaaagtgtgacattatcaaacatgagcaaggatggggagcaggagggtgccgatacatgcaggatcaattggtcaagccacttcaggcaaacattggcattttattataaagcaaaagatgaatatatcgtatattttagccattccatcctggaggagctaacctaaataaacccatgtttatcatggattatgcccaagaacattcctagcaaatttgtttgtacaagctaaaaattgataacaatctaaatggaccatcatagaaaaaatgagaagtaaattgtcatatttacgctcaatggggctactacacagcagtgaaagtgagcaaactatagccaccagtatcaaaatggatgaattccacacatactgttcagagaaaaatgaatattagagcggaatgcattcactatgattccattgacatcaaggcttaaacgttcatttttcattggaggtttatcactgcttatgtatataagcagttgaatgactaaccccaaattcagaaaaatgggtgtttcttggggtaaagaaatgtatgaattagaagagtgcagcaaagtggaattcagagatatggataatgttgtttctcaaactgctggtgaagagtgttcttctgatgatcgttctttacactttatgtgtagcatatatatttcccagcacctggaaatgtaatagaatattaataacaaaaaattatctcatgcaagtttcaagtaaaagaggaaaccaatattaaaattgcaaaatatctagaaaataagaacacaaaataatacaaataggtataaaataatacatatcagacctgatgggatacaactaaaacagtgaacttctggacttaatgtctactctctcatgtttgttaatctgtgtgaattaagaagttaactcaataaattagaattttttcaacagaataaactgaaaaaagtagaagaaagaaaattgggtatccagaaattaacaaaattaagaaaaacaatggcttcttcaaggaagctaggggggtaattggcccagtgattttgcacctggaaaacacacacacacacacacacacacacacacacacacaccccatcaatagagaacatatgaaaaacacaataacaacattaggtcgggtatggtagctcacgcctgtaatcccagtactttgggaggctgaggtgggtggatcacctgaggtcaggagttcgagaccagcctggccaacatggtgaaaccctgtctccactaaaaatacaaaaatgagctgggtgtggtggtggatgcctgtaatctcagctactcaaaaggctgaggcaggagaatcccttgaacccaggaggcggaggttgtggtgagccaagatcatgccattgcactccagtctgggcaacaagagcgaaactctgtctcaaaaaacaaaacaaaacaacaaaaaacaaaaaacatcacaatgacaacattaaaacattgcagcctgattttttaaatgaggtagatctaactaaactgacacatccaaaatgattggtaggatgcatcactgatttttataaaatgcagaacagtgtatgcagtcagcttgaaaacatttagttaatttcttaataaattaaacacgtactacttgttagacccagcaacccaaatactggttatttatcctagataaatgaaagtatgttcacaccaaaataaatacgcaaatatttatagcagatctattcataatcaccaagaagatgtggccttcaacaagttaatagataaaggagatgtggtacatcctcatgttggaatattactcagcaattaaaatgggacaagctattaatacacacaactggatgaatctcaaaggcattatactgagaaaaggagacactcaaaagcctacatattgtgtgattccacttacgtgatgttctcaaaaagataaaaccatagtaacagaaaagagttcggtggttgccaggggttaggagttgtgtgggaagttttagggacactgtgactatggaaggatagtacaaggaagttttttggaatgatgaaaccatgctgtatcctgatagtggtggtggttacatgaaatctatatatgtattaaaattcatagaaatttatataaattgtgtattaaatttcatgaatatttggtatgataatttaaacatttacttatatatgtttaagtaaagaatatctttagaaggttgcatccaaaattgctatgagtagttgcctccagggagagaaacaagacagatggctcagctcagggagagggaggaatagaacctttcctatttactcttcttgcctttggaatgttgttccttgttcattcatgatgtacaaactttgaatgataatgtacacactatacgttctaagttaagaaaagaggttgctatagaatggagtgctttgctgtcattggtaggaacttggtctagatttagaaagcaggaggcgagtctgcaaaggcccagggtgtagccctttcagaaggaaatagaccttgccaagacattggtatctaaaaaaaaaaaatagggtgtttaccagttattactcatttggtaccaaaatcattagagtaagagttaagttgggcatatctaatcctgatctccagatacatgtgtttcgtgatctttatcgagctcctagttaaggaaccacaccagaagtaatagcatcagattcaaattattgactgaaaaggaatacattttaccctcaacttcttgaccatagtcatgaaaaaaaaaaaagtccacaaacgatgagtactatattcagtgcatttggtgaaagccttcaatcaactccaaataagacaaaagtcctgtcctggcttccttcgagtttctcttccccttgagtgttcctggtctccattcccctagacttcccactgttactgcctcacactagtcttggctaggataagtctgttgtatcaagagtttattattatttgcagaacaggttaattagtctgctttctgttgcttataacagaatacctgaaactgggtgatttataaagaaacaaaattgatttctcacagttccagagactgggaagtctgaggttcagagggtacatctggtgagaaccttcttattggtgaggactcctttagaagtcccaaggcagcatggagcatcatgtggccatgtgctaactgtactaatatgcaatgtgctacctcaggtctctctctttttacaaagtcatcagttcccttcccatgataaccccttaatccatcaatccatgaatggattaatctattcatcagggcagagccgtcatgattcattcacttcttaaaggcccgcctctcagtgattgccacattggggattaagtttcaacatgagttttggaggggccattcaaaccatagcaacaggcaaggcctttgctaatgcttttgctcaaggttattttacattttaaatttttattgcttctctggctgggaaatgtggctttcccctaatttattctgcacgatgaatagagagaaatggctttgccacctgcttgcaggactccacggttctgttacttccagtctgtgtaatttgtatgtatattcttgcctgccaccccttagttctaccgctttgtcttggtttcttgcctagcaagataatgggaaaggttgttttactctatcctttagggctggaaaaataactttcctcttggggtctgagctcttatctggacaccatagcacatcttgtatgacccagtaaatacccttcatcttgctgtgagcaggtctgtattggggctccttttttaaaaaacacacacgttatagcatgtgaattcatgcctatggaagttaaaactataacccaagcaaagttccaggaatacatttcaaaataaataattcctattattcaagaagaatataggctacaaacttttgttcctaggtagggaagggctgtaggactgcaccatcctgcaaatttgctgggactgctgtggtcatacaagccaattcttcctggggcattttcaaggggggttaggtattggaaacacaacggggccctgaacttatgcacatgatggtgcttttggactcagcaaaccatgtgtccttgtctcttgggcttcataaaaccaaattagaagtagactagacagtctccctctttgtccttgatgtgtgcccagcactatgccatgtatttttccttctcagattcttgttctcttaggtcaacccattttacagataggattcaggtgaggtgacatgtccttctacaagtggaggagctcaatttctgacttcacagcccaggttccttctttatccaagactgttcctatctatatgatcagaggtccctgtgggtggtatgtcaggattgattaaaattaccaagacacttcccgccaggaatgggtatggtactctaagtggatgctcaatacatatttgctaaataaataagacacatcagtctgaaacagcaggtacaacctgtagcctaattttacagagagatgaactaaggttcagagtgatttgccttcaacaatataagtagagaggatgagacttacttaaaagaatcctgagctattctgcagaatgacatacagtgagtataaataaaggccaattctatatcgggcattgataaatgaataaggaacaccttacaacacaaacagtttgaatagaaatataaattgatatatattaatttatatatctataaattaaatataaattatataatttatatctataaattaaatataaattatataatttatatctataaattaaatataaattatataatttatatctataaattaaatataaattatataatttatatctataaattaaatataaattatataatttatatctataaattaaatataaattatataatttatatctataaattaaatataaattatataatttatatctataaattaaatataaattatataatttatatctataaattaaatataaattatataatttatatctataaattaaatataaattatataatttatatctataaattaaatataaattatataatttatatctataaattaaatataaattatataatttatatctataaattaaatataaattatataatttatatctataaattaaatataaattatataatttatatctataaattaaatataaattatataatttatatctataaattaaatataaattatatttataaattatattatttatatttataaattatattatttatatttataaattaaatataaattaagtgtaaggataaacagccatcattaaatgtacaatgaccagagtttccagtacaaaagccaggtctattaagtaaaaatatgtttattggaccaataacaacagtaataatagctcacctgtttagagtatgaaatcaagaatgtacttctctaggcagattgtctgggttctaatttcagctctactacttactagctatggcacgatgggaaagttacttaacctctctttttatttatctatcatctcaaaatacctgtcttggtaaggttgcgttgaggaccaaatgagttaatatttataagtcacttagaatagcttctggtacatagtaagggctattctattttttgttaaatgtaattacttttaagcatctttatattctccaccacaactttataaagaatagtgctctaccattttacagatttggaaattcagcttggagagttcctatgagtagccttctctcatacagctgggattcagaccccacctttggttggccctgaagccagggctctctcccaaccccaactgttcttagatgaagtttgcattaaaatccacagcttagaattcacctttcctgctattcagcaggcgctcctagaaacaaaaccaaacataaaacagtattttgagtattctaccttagtctttttttttttgcatatctaaaagccaaaattaaggaaatggaaagatgttaatataatacacacacacacacacacacacaaaaagggtaattactgattttattaaaaacatttatcacagagccacataaccattgttatttcaggcctgggaatacaatgcatgctattaagccatttgatgattaaagataaaagcatgattaaatacgttaatgaaagtgccaggctgcatcaagaggcacaccatgcattgacctcgaagagcttgggctacctatgtgacccctttgtgaactttctcctcagctgggttttctagaaggttattttgtgctgaaaaaaaaaaaaaaagtcctgtgagtaatgaaattctacctgatccctgggacctgaccggctaccctggccttctgtcctctggctgctgttgcaacccattttccttgtcttcttggtggaattagaaaccggcccgctggcattttcctaccaattccctctattctcaggtctagagagaaaggaacaaaatgcagacaggattgaactaatatttgttaagactcaaccgctggccaagcattgtgctgtacatttcatgtattaagacattagttctgatttattatatttctatccttatcactgtcctgtttttacatagaagactggggctcagagatgctaaatacattggcgtgataattatgagtggtgtatctccaatgtttttggttctcctcctgagcacacgatgggctttcccttctcggccaagaaggcttctcccttcttgggttgggtgcatccgtgtgagtgtaagtgacatatgtctcatctccatggaagcttaaagagctagttatgggtcaccatgtgctcctcctctggcatctgcttcatcagcttgggtccacatataattagaatttgtgatttaaaaatgagtacactggtttgtgtgacagatttggaagcctgatttctcatccacacgattcaataagcatagccctataggtcctctcaggtatattatcccaattcatatcttgggccttctaacctgcccatggatatataaagtgagtgggaaataaatattggtggttttcaagccactaagatttggggcgtgtttttactcctgcataatgaggtctcacaacttatgtggacctgggagctgagatttgaatgcacttctgtctactttcaaagaccttgctctttctactgccttgaactctattaataagatgtggtcagatcctaggatccaggaggacattttccttaccatatgaaaaacaaggacagggcacaggcatagcctctggtcagaggttgagaaaacatagactcactgaggatcccagcagggaaaagtacaagactcagaatctcaaggtgaggttaaaaacgtacggattgattctgtaaccttacacaaaaatcacctaatctcagtgttttttttcacataaataatgggaataataccatccattattcaatgtccctgacctccaaggagccctgatactgaaagatattctcatttttttctcaagtcaggaaagatatattcagggattacacaaattattgtgcaacattgttcacaacctggaatggagaaaaaggtaagagatacaactgaatttaagtggcagtaatctgggccttggacaaagggattaaagaaaaaagagaagataggaggaaagtactctggaaatagattcaactggaaagcatcagtatcaccttaaggaattaagtcaataaagaaggcccaagatatgaactgggataatacacctgagagggtctatagggctatgcttattgaagtgtgtggatgagaaaccaggcttccaaatctgtcacacacaccagtgtactcatttttaaatcacaaatcaaattagtaaaacatttctgagcacatattccccatatgtacacatacttattgataaatgtatgtatacattactagagtaatgtattatatgtacattacatatacaatttgggtacataaaacatacaccaaaaaagaaatgttaagaagatggctaaataaacagaaggagacagtcaaatgtgttcttcccattgagcctggtttgggatgtatgtaaccctgagttaatggctttgcatctttctgcctgaaagtgactttattgccaccagtcatacaacgcgggaggaaaggggcatagaaaatcttttcaactacttgctctggctcaacctttcgtggagctgaatgctttaaaaaggacaatgaacaaagtgaaatatgctttaatccaattccaatgaaaagcagtcaaatggcaaatatagtcttgcttcttttctcttttcagtgtcacagaggattgtaaaccatatgtcctttggagaccaagcagagagatagccacagcttgatttgcagagatgcattaattttcacatttaagccagtagttcctgttgctcatatgaaactcaccctccttctatgaccctaaaattctgtcatttcaacaaataattgaagagttcaatttgtcacctggctatttaaaatagtagagacaggaggccaggcttggtggctcacacctgtaatcccagcactttgggaggccaaggcaggtggatcacctgaaataaggaattcaaaaccagcctgaccaacatgatgaaacctggtctctactaaaaatacaaaaattacccaggcatggtggtgggcgcctgtaatcccagctactcaggaagctgaggcaggagaattgcttgaacctgggaggcagagattgcagtaagctgacatcacgccgctgcactccagcctgggagacagagcgggactccatctcaaaataacaataataataataaagacaggagtagctctgaacttattctggtccagagggttggtggaggctgtccaataaaataaaactaagtaaataaaataattaaaagaatgaagtcgtgaatgctaccaggcatatttacgtaacttaagaatcacttgatacacagagcagtaggcttaatggctaacttgtttggttggggttaaaagaggggaaagaaagggaagagcaagttcagtagaaacttgaaagtgccttttttatagggggtcattgggatttgaattccatgaaatagtatatcgtaggtatgccctgcccagctcccagaatatcggacctatcgaatggaggctatttgcatgcataaatttcacagatgtgtatgcataacttatttctactgacctgcagagcctagtaaaatatttggaggaccaaaggctagatttataataaaacataattaaaactcagtaaattcaaagaaaggctggaaaggaaggaaagggcattttaaaaagcaagacaacgtaagatgtgagaaagaattttcaacttatcagtattctcaaaaaatgtacttaaactaaactccctaatttaaatgtgaaaatgttacatttgattagaaaacaaaatccaaattatacaattttaaaagacacatacataaaatgtaataatgcaaataggctggaagtcacaggtgggaaaaatatagcaggaaactggtaataggaaaaaagttgatgaaacattattaatatcagataaattagactgaaagcaaaatgataaattattttattaaaataagattttaattttcagttataaaatgtttgtttattctgaaagttccaacaattctaaacctgtatgcacataataacttgatctcaaaatatgtaaagccaaatttgagacagttgcaaagaggaaattgcaaatctgtcagtgagatggtttttttttaacattcatttattcattcattcattgaacaaatgtttgctgaacaagaattaattgaacaataaatgaatagatgggattacacaagttgttgtgcaacagtttgggcccacacataattaggattaccaataacattttattattagaaacatttaaaaataaaatcctctattttattccaggcatccttctaggtactgaggaaattataatgaataaatcacaattcccctgaagcttatattctggatggaaaagataatgaaaaaaatatttaatatgcctgatgttggtaagggctgaaaaggaaaaaacaaatgagggtaaagggacagaaaattaaggagcaagggagctattgtttagattgtgatgaaggtaggattccctcataaggtgacctgaatgaagtgagggagtcaatcaggttatagatttgagaaaatcattccaaacggtagaatcagtaagtttactggctctgaaggggcagagttcttggcctgttttaagaaaagcagggagactggtatgagcagaaggcataagaagaatgcttggagataccagatacatctctgtaattgacagacaaagtagacaaataactagtaaataaagaaaagatttatatgacacaattaataagaacaatccagttgacaagtataaaatgctgcactccgagattagagaatatacatttagcttaggaatacataaaacaattacaaaaatcaaaaatcaatcaataaagcaagtctcaaaaattttgagtcagcatcacacaaactatattctctaatcacaatgagatcaagttagaaagaaaagcaaaaattttacttttattaaagtttatacatttggaagtttgaaagcactcctacaaaatagttatgtcatgaaaatgtcttaaaggcaacagataagctatttagaattgaatgatcataaaaataatacaaataaaactcttgggatttggctaaactcacaatttcagggaaattcctagctttaacatgcttacagtaatgaagaatatccaaatatttaatgatttaagcaatcatattacggtaaaaaagaacaatagattaaacctaagggtaatggaaagaggatataactaatattagagaatacattaatgaaataagaaaagctaaaacagagtgtatcaacaaagccaaaactctttgaaaaggcataaaaaaacacaccaaactccttttttctctccagaaaaaaagttggcacaaacaaaaattgttaggaataaaagaggataccttaacatacagctaatattaaaagtccaagaaataaacttacagattggtaataaccaaatagcctgaaacaccaagtatttgcaattaattagaacagcaaatatttaaatactcctcatgagaatgcaaattgctacaaccacttggataagcagtttgcaatcatctattaaattgaagatgtgtataacataacatccagtgatttactcacagatatgtagcctagactagagaaactcttgcacatgtactctcaggagataaatacatgaatgttcagagcagccttgctcactaatagctaaaaaatctggcaccaacataaatgtttatgtctggagaattgatgagtaaattgtattaatagtttatatctattcatatagtctgatcttgtaagacagtaaaaatgagtaagccagcacaaaaatgagttacccaatatggataactgttgtcaaaaacgtgaagttttagtgaaaactgcaaggcaaagaagaatatatgtgatattcttccttttatatatatttcagaaacgtgcaaaatatattccaataatatttgaatatctcatttgagatgtgtgtgtgtgtgtgtgtgtgtgtgtgtgtgtgtgtgtgtgtttgtatacatatgtaattttttctaggagagtgcctatccctccaaaagcaattggaagtggatactgtagggaggggcacaagtgaatttcaaatgtattgatattgttctgtttcttaaggaagatgtttcatagacagaagtgaattttatttttcactacatatactttgtaagtgctctttttatatatgaaatgattcctattaaaatacttaatgatgaatgaatataataactttttgtcaataagtgagactaaaaaggtatatccttgaaaaatgtaactttcaaaactgactcaagaagtaaacaaaatgaatataattttaaaaaatgaatcaataattgaaaatcttctcaaaatgctaagcccaaattgttttacaagcaaatttgaccaagcattcaaagaaaatataatttctttctttctttttgcatactctttcagagaatgaaaaatataggaaaatttcctaattcattttgtaagtctaggatattttgatatcaaaaccacaccaggacaaaaaaaatgaaggcatattagcttaatgtcacttatacataagaacaaaattcaagaatgcatattaaaacatatcatggcaaagctagagaagtgggggtataaattggtataaccacttttaaaaactgtttgacagtatacaacagggaacagcaaactttctatgtaaaaaccagataataaatattttaagctttgcaggttgtactgtttctatcacaactattcaacactgccactgaggtgctaaaacagcatagacatacataaacaaataggtgtggctgtgtttcaataaaactttatcaacaaaaattgttggcaggcggaagagaagggttgtagcttgtagatccttggtgtatatagaaagtaaatatatactacccacaccccagtaattccacttctaggtatatttctcacagaaatgcatatatatcttcagcaaaatatgtgtagcgttcatgatagcactattcctaatgtttattaacttgaaacaaaaatgtttctcaacaatagaataaatgaataaatgtgggatattcatgtaatgcgcttttatacagcaatgggaatggatgaagtaatgttacttaaaacactgtggtggactctcccaaacctaaggttgaacaaatgacacaaaagagcagatgcttatgatttattctagataaaagttcaaaaataggcaaatacaaacaatgaagttatcaattaggatactggctacccttgtgggggttagtgacggggaaaggcgtgatggggtgggcttctgagggctggtaatattttgttatcgatctgttacataggagatgtcagtattgtggaaattcaccttgctgcttttttatgatttatgacctgcttgtatttatcaattaaaagtttaaacttaagaagtaaaaatagtaaatagatgaaggcaattttgggttcattgagagactatgagggttgtctgacattggaaaatacattaatgtaattaccacattaatcaaacaaaatagaaaaattatagctgcctaagtgcataaaattatttgctaagtgcataaaatcattaaactaaaaataccccttataaatctaggaatagaaaagaactttcttattctgatgagggacatcttcagtcaataagcatcataataaatgataaatatgaaaacattgccttgaaaaccaagggaaagtgaggaagggatgcaccaacactacatctatttcacttggtgttaaagacagccagtaagggcagagaatttttttaaaggggagtaaaatgaataattactggaaaggaagcaaaacaatgttatactagtcacatgtggcatgattgtctagagaggaaaaaagattacaatataaatcaaatttttgattacaacaaattataaatagtaatatgctatatcaaagtctctggatattagatcagtatacaagtcatttacatttttatataataattataaaatttaattcaaaaatattaaaatagcatttaccttgctgatgggggtagtgagtagactggcataaagaggcttatgtgattctggtaacatctttcttgatttttgtctggttatacaagggtgaagtttgtggaaattcagagatgcgtgtacttctctgtactttatattcaaataaaaagtttaaaaacaccatttacagtagcaacaaaaataaaacatatatcaaaacaagtgaaaaatgtgtaagacctagaaaattataaaatttatgctaaataaattttaaaagacctaggtaagttaagagacataccatgttagtggataaaaaaactcaaattacaaacagaactaaaaataaattaaaataaatattcatcaaaagaataatgaatgaactgtgatatagtcatacaatggaaaactggatagcagtagaattaatgaacttaagctccatgtatcataatgaatgaatctaactaaaatgatagaagctgaagaagggtatgtatatgataccaattacaactcacccttggacaatgtaggtttgaactgaaagcatccacttatacaagggttattttcaatacatatattggacatcttgttggaggtgtgcaatgatttgaaaaacttgcagacgcatcatgcagcccagaaatatcaaaaatcaaaaaatttttaagtatgtcatgaaagatgtagatagtagtctattttatcatttgctaccataaaatattctaaaatctgttattaaaaagttaaaattggccaggcatggtggctcacgcctgtaatcccagcattttgggaggccgaggcagctggatcgcaaggtcaggagatcaagaccagcctggccaacatggtgaaactgcgtctgtactaaaaatacaaaaattagccaggtgtggtggtggatgcctgtaatcccagctactcaggaggctgaggcagtagaatcgcttgaacccaggaggcagagggtgcagtgagctgagattgtgccattgcacttcagcctgggtgacaagagcaaaactctgtctcaaaaaaaaaaaaaaaagtttatcaaaacttacacatatacagactgtacatggcaccatttgcagtcgagagaaatgtaagcaaatataaagatgcagtattagatcataactgcacaaaattgccacagtagtacagtatgtactacagttaattttgtagccacttcctgttgctattgctgtgagttcaaatgtcatgagtatctccttaaaatgccatttgaggctataaaccaaaaagtatgagacaggtcttaatttagacgtttattttgccaaggttaaaatcatggcctgtgacacagcctcaggaggttctgagaacatgtcccaaaggcggttgggttacagcttgattgtatacattttaggaagacagaagttacaggcaaagacataaatcaatatatgtaaggtatatgttggtttggcctggaaaggtgggacatctcaaagccgggtagagtgtggggcttccaggtcataggtggagtcaaagatttcctgattggcaattggttgaaagaattaagctcttcctgaagagttgagtcagcttgagttaaggtaaggtaagagaggtcgagttgtggaaaccaaggttcctgtcatgtagatgaagcctccaagtagcagagttcagagagaatagatgtgcatgtttcttattagagctaaaagatgtcaaaatctcctgaaaagacctcgtaggggaaggagagtctctatagaatataacttcccccgcaagagatagcttttcaggcccatttcaaaatatgtcagggaagtatattttggagcaaaatactttgatttcctttaggacccactatctgtcatgtgatgttacactagaatcaggttggaatttggtgtcttattgctacagagtctgttttgtcagtccttaagatctctattttaatgttaacactagtcaattttgtctaacctccagagggaagagggtgtaatgagacatgtccaaccgcccctgccccctgccttcctgaactagtttattttcaggttttgggggatctctttggccaaaaggaaagtctgttcagttgactggggggcttagaattttattttcgatttacaaggctgacatctccatatgatcagttcatctttccagtacatcacttaccacaataaaaagtgatctcttgaggttctcgtgtatttttcatcatgtttggtgcaatagtgtaaaccttgaaaaacaccgtgatacccatacaaagtaccactagtgatgctggaagcactccaaagaagcagagaaaagtcatgacattacaaaagaaaggttaaattcttgatatgtaccctagattgaggtctacagctgcagttttctgccatttcaagataaatgaatccagcacaaggaccattgtaaataaaaaaagaatagaaaaggaaatttgtgaagtgatcaccacagctataccagcatgcatgaaaaccttgcactttttgcaaaatacctttttatatcatattgagaatgcggctcttatgtggttgcaggatttctataagaaaggcatatctgtagactctaatatcattggagtaaaaggcaattattatatgacaacttaaaacaaaaggaaggtaaaggatctaaagctggggtatgtaatgccagcaaagggtggcttgttaatttttgaaaaagatttcgtttaaaaaaatgtcaagaaaagagcctggtacaatgttgggtgcctataatctcagctacttggaagtctgaggcaggaggatcgcttgaacacaggagtttgaggtcagcctgagcaacagagagactttgtctcaaacaaacaaaccaaaaaaaatcaagataacaggagaagcagcttttgcccaccaagaggcagcagacaataccccagatgccattaagaaaataattgaggagaaaggatatctacctgaacaagtttttaatgccagtgaatgtgccttattctgggggggaaaaatgccataaaagacattcagttataagaaagagaagtgagcaccaggatttaagacaggaagagatgtgctaaatctatgattctgtgcaaatgcactcaggtttatgacaaggactacccttatctgtaaagctgctaagccctaagccttgaagggaaaagataaacaccagctgctagacttctgattgtacaagaagtcctggacaacaaattctgaattggttccattcgttctctgggtcaggaagtaccttgctggtaagggactacctttgaatttattttgctattagacaatacctctggccccctagaacccaatgagttgaacatcacaggcaatgaagtggtctgcttgcccccaaacacaacgtctctaattcaggggtcatgaggatctttaagtttcattacacattgtattctatggaatgcattgtcaacggtataaagagagcccatgaaagtctgaaaggattacaccattgaagatgtcatcatcgttatacaaaaaaccatgaaaactgccacgcttgaaacaataaattactgctagggaaaactgtgcagatgttgtgtgtgacttcacagaatttatgaccgaagcaatcaaggacattatgaaagagattgtggatatggcaaaaaaaaaaaaaaggtggtgaaagtgaaggatttcaagatacagatcttggagaaattcaggagctaatagacacttcacaagatcataagaattaacagcggacaacttgttagagatgagctcttctgaactggtgccagaagatgaggaaagacatagaaggagcggtgccagaaaacagatttacattagattatctgacagaacggttccaattattcaagaccacttttgacttcttttaggacatggaaacttctgtgaaacaggcactgaaactaaagcaagaggtggaagaaaaattggtaccacatagaaacatttttgagagaaataaaaaagtgaaaaagacaaattgcaatgtgtttttgtgaagttacatggggtatgcctgcctctcctgcctcaccttccacctcctccacttcttccacttctgccacccttgagacagcaaagccgacccctcttctttctcctcttcctcaggccagtcaataggaagacaatgaaaatgaagagctttatgatgatccacttccccttaatgaatagtaaatagattttctcctctttatgatttccctaataatatttttttctctagcttactttattgtaagaatacaatgtataatacatataacacaaaatatgttttaaccaactgttcatgttatcagtaaggctttcggtcaagagtaggaaagtttttggaggtcagaagttatacatggagtttcaactgtgtgggggtgggaggttggcacctctaacccttgcattatatacaagggtcaactgtatgtagtttttaagtctgccagtcaatactatgttattcttagaaacttatatatgaaaaggaaacatggatacctacatggaaatgctgaaccctaaattcagtatcttaggtgctaggtttggggaatttgttatattttaacctgtattttcccctatgtcttaaatagcttatctaaaattcttttagaattgagctacctcttcctcaagggagcgctgagactctaacgggaaaactgaaagaggctttgcacatatttatcagaaaaaccacttgtggatggtctgtgtgccttttgacagttgccagagaattattgctttatttcttcttctccttgttaattctttgggcataaagggtaggatgccaggtgcatggacatgccaaataaagagagaaagtataggtgagactcctccactttccagccctttctgcccctttcagccactgaggtaggaaatatgaattgcaaatgcagaaggcactgccctctggcctagagaagagagggtagagggctaggtgcccagttaaagtgctgaacctaccacagcttacccagtgacctaagacaacttgaacaaagaaaatatggcattaagagtgtagcactttcctggattatcttttgccattgggtctggatagctcacatctctgagtctcactgttttcatctataagtggggacgttaggcctgatgatctttaagttctttgctgctctggaaatttatgagtctaacactcagaggccttaaatttcagtgaggaagacaagaaatgtaggcaaataatgagagtcaggatgacaaggcccagtgtccaatgagaggtttgaatattcttgggagattagaggagggagattcacttgtgcccgaggaaacaggaaaggtttctagaaagatgtgatgctaaattaatgttttctttttagagcagtaacatttgttcattatagaaaatttggaaatcacagaagattggggatagaggaaacatttatttcacgtatctatccatctattcatccatccattcatctgtccaaatatttgactacttattatatgccagctatgattctaggtaccaggaaatggcagaaaacaaatacacaaagttctttcttttgtacaattaatttttcaggctaaggtgggggaaataatacaagtaaacaatcatataagtaaataaacaaggtaattcctgcaagtgccaagagaataaaggagattgatatgatagtgaaatgatagttgggggaggggcgggagtttttactgagctcatggaatgcctctttgatgacacattattcccaaacccacaactgagagttagtcattgatatctgagaggtttctttactctgtgtatttccttttacaggtatgttctcacccaccgtcctccgctaaatccatgccttatgaagagactctctttcatagcctctacttcattattctttataactagaacctccccatgcattcttataacatttgcaatgagaaaacgttgtttccctaattttcaaagagatcaataaaaacaaattaaaatagaggattagaggtgtctttttgccacattatttttccaagaacaaaagatgcagtgatctcatcattatttctccagaggtctctaaccataatatacagccatttagtgcagcttaacatgacaataactcactgcttctctctctttactctgaaaaaaacaggtagatgaaagggtcgagatgattgagaaaagcccctatcttcatatttaaaatatactataagttgtatgggcttatcagtccattttagggtaagacttttctggaagacaacaggagaggatgggcaatgtgattgagtatgtgtacctccactgaagatggggaggttaaatggaggggtatgaagaggaagaaatgagctgggccaaatgctgcctttaggaatgtgttgagcagcttggggagagaaaaagaggatgctgggcttcagagtccaagcaattgaaaggaacatttcaatcaaataagaaagacagaagacttctttctgaagtcccaggggtcaaccaaaaaacttttggatggatgtggttaagaaggcacaccacttcttccctctgacagctgttgtggggctacgtgaaatgtcatctataaagtccccggttcagtgtggaagatcaaagtctagcattgtgattaggaccttaggccctggtgacctcaccaatgagttcttatcctaactgagtactcactctaagccctcgtttcctcatctgtaacactaagttttcaacacctactttatagggtggctgtgaggatgaaataagatcactgacgtactgtgcttagtacagaacctagaacttacagaggaagagttcaataaatgttaacccagacaataataatgatgatgagtttcttagtcttaaaaaaaaacccctcaaagtcctccaaatttcctccttctacaaatgagtaaactgaggcatagaatacaatcattaaaaacatggacttagaacacaaatctgcacttaaatgccagctctgccattctggctgcatgccatggttaatttgcttctagactcttggattcctcatctgtaaaacaggaactttgtgacttgtaagtgtaagaggtaaatgtgacaccagcaaaatgcttagccaagtccctggcacatagtatttaaaactttacatgaggcagttaggtatttgcaaattatggttgtttttgtggttatcatttaaggtggatacaagttagcagccatactagggaatcaatctattgaagcagaacaatatcaagtagacaaaaaataactagagacattgaagatctgagaaatagaatgaataaactcaagcttattaacatattgacaaattagtgttaaataattttaatatatagaactccaaatgcaaacagagaaagtcattcttttgagcacactcaaaatcatcacaaaaatagaacatgtattaggccataaaagcagcccaattaaaaccaaataattcatataacacagagcatgttccccaactgttatgcaataaacttagaaattaataaccaaaggacagatttaaaaatctcatgaatttgacaactaaataacatgttactaaacaacactttggttacaaaggaaatcataaaggaatcctgaagtgaataataatgaaagcagaacaagtctatatttgcacaacaggctgaagcaacacttagaggaaagtctaaaagtttaaatttatttaacaggaaacaaaagttaaaaacaaatgacctgtatatacagatggcaaaaaaaaggaacatgaagaaaatgtttaacatgattagtcattaggaaaatgaaaattaaaaccacagtgaggaatcactacacacctatctgaatggctcatataaaaagtagtgatagcaccagattatagcgaggatgcaaagaaactggatctctcctacgttgctggtggaaatgtaaaatgatatagccgctctggaaggtactttgcctgtttattttataagtaaaaatgaacttactatatgatccagcaattatacgcttaggcatttattccagggaagcaaaaactcatgttcacacagaaacttatacatgaatgtccatagcagatttactcacaatcaccccaaactggaaactacctaaatgtccttaaatgagtgaatagttaaacaagctgtaaaacacctatagcatgatatactactcaggaataaaaagagcaaactattgtacctgtaacaccttggatgagcctcaagagaattatgctaagtgaaaaattatgctgagtcaaaatgttacatagtatattatttcttttatataacatttatgaaatgataaaaaaattatagatggagaacagattagtggctgcctggggttttagatggcagggaggagagaaagggtgtgtctataaaaagatagcataagtgtcttagtctattcctgctggtataacacaatatgttagaataggtgatttagaaataatagacattaatttctcatagatctggaagttgggaagcccaagatctggcaaatttggtgtgtgacgaggattcactctctgcttccaagatggcacgctgttgctttatcatccagggtggacaaacgctgtgtccttacatggcagacggacgggagaagaaaacttgccccctcaagccctgttctaaggcactgatcccatctttgaaggtggacccctaaaggctccacctcttgacacagtattcccccttgatccacagtttcacttttcttggttgcaattacagtcaaccacagtgtgaagatagtacatggaaaattccagaaataaacaattcataacttttaaaaatgtcacttttctgaatactgtgatgaaacctcatgccatcctgctccatcctgccagaatgtgcatcatccatttgtccaacatatccatgctatatatgctactcacttattagtcgcttagtagccctcttggttatcagactgaaaaatcagataagaatacaagaaaagaaaatacaggcccatttcatgcgtgaatgtatagaaaatacatcgtatgttaaatactaactaacgaagtcaacactgttttacaaaaataataattatatggggcttatcccaggagcaagttttttttcaatgttcgtgcaattcactactttaaatatgctaaagaataaaaatcatatgattatttcaatccttgagacaagcatttgatacatgaatgtccatagcagatttacttataattaccccaaacttgaaacaacttaaatgtccttaaatgagtgaataggtgataagcatttgataaaggtattcaccaatttatgattattttttaaaacccttagaaaataaagggaaacttttgttagattgctagtttataagccaaaattctacagcaaatattatacctaatgtagaaaatgcaggtgcattcctttttggagcagggagaagagtggagccaccattgctatttaacataatgctggagtttctggcccaaactttaaggaaagaaaaagaaataagatgtatgaggattgcaaagaaataaaactcattgtttgtagatgatatgataatccttttagaaaaatcaattgcaatcaaaaattgtggtaataagagagttcaacaaggttgccagatataagattaacttataaaaatcaatagcatgtctgtacaccagcaataatgaactagaaaatctaatttaagacaattgtaatacaaatgatcaaatatttaggatttaagtagtctaagaatatataaaatctcaatggagaaaactttaataagagagttaaaagaagacctgaatagatggagaaaaagtctatggccatggatgggaagatattacacaagtgaaaatcccccctgaatttatctatgaatttaattcagtgtcaataaaaatttctgttaagtttttaacgaacttgataaactttctctaataaatatatatagaggggaaaaatcatagtagtcaacttcaaggagggattaaaaacacagaagatgtacccttccatacatgaatctataaaatatactattaagccataactataaaaatgcatgctgtaataggcagtggatcaatagaacagaatggaaagctcaagaaccatttcatgtatgtctggaaacttcatgtgtgatagagatggctctacagatcaactggactgaatagtaagcaaatggttttgaggaaaactttttttactgtgcaggggaaaataaaactgaatgccaccttaatacctactcccagggtaatggactttggagacctaagatgtcagtgtgaatgataaagctacaaagttagaaaagaatattgcagaatgactttgtagactagagttgggcaaagatttcttcaaaaaaagtttgtgtctttcatagggaaaggaagagagggaaatcacagctgtggctcacccacacagcatttaacaacaacagatttgatatgcagttgtagcagtgtggctggaccttaaaagcataatgctgagtgaataaagtaagaaacagtgagacaacccaacaccatttatctaaattttaaaaatgcacatgtaataggatgcattttctaagaacacaaaataaatatattaaaatggttgctcatggtaggagagtggggaatgggataaaataaattaaaaaaaaaaaagtcaggataggctaggtatgctcgaggaacaaatgaccccaaaatctgatggcttaacccgcaacagaaatctctctctcgctagtgtgttgtgatcacataggtcaacaggggaaagtgaaatgggccaattacacttgggctttaaaacagtcctgaaagtgacaggtgatatcttctcacttatcactgggcaaggaaagtctcatggctatacctaacttcaaaggaaagtacaacctgaccatgtgcctggaacaagggggacgtggaatatttgagaacagatttcatgtctaccattagggagacatttcaaaaaaataacaacatgtatacatatgtaactaacctgcaggttgtgcacatgtaccctaaaacttaaagtataatttaaaaaaaggtaaaaagataaaaataaaataaaaccttgagaatcagcaaagaacacacacacacacacacacacacacacacacacacacacacacacacacaaacttggttgattttatttatttttcatatttctttctctctttctttttttttttttgagacagagttttgctcctgttgcccaggctggagtgcagctcactgcaacctccacctcctaggttcaagcaattctcctacctcagcctccagagtagctgggattacaggcatgcaccaccatgtccggctaattttgtatttttagtagagatggggcttttctcagttggtcaggctggtctcgaattcctgacctgaggtgatccacccgcctcggcctcccaaagtactgggattacaggcatgagccactgcgcctggcacttggttgattttattacatcaaaaataaaggactcttacttattagagattatcatgaacaaaaaaaacccctagaatatacaaagaattctacaaatgagtagatgattgtgcaaaggatttgaacaacgagtttataaagataaaaatccaaaaggctgaaaaatataggaagaaattctcaaactccttagtactgaaacaatataaattaaaatagtaatggtaaaaaatacgtagtgcccatcagattggtaaaaaggtagaaaaattggataataccaaaggttggatgaatgtgggttcacaggtacctttacatacagctaaaagttttggggctgctgttctgaaagcaatctgacagtactttgtcaaattaagtttacacacagcctatatgtcagtatttctgcccctaggaatgtagaccacaaaggaattcacacaaatctagaaggagacacctgagaaggtctactacagtgtgatttctgacagtgatgagtaagaagcaaacagtgtctgtcagtggggagcagattgataaatgatggagagaacacaccccagaaccccatgcaatggttgaaaatcatgaaataagggcacacagcagcctgggtggatgtcagaagtgtagtgctgagtgacaaaaaggtaaacgagctagaacacattccaatctacataattaaaaatacatgcatagtaaacaattacatgtattttacaagaactcattcgggcagaagacagtgtataaaacataatgggtctacagaaggaaggcagtgaaagtgaagagtgtcaataaacatacagaaataagcagagcaatctttgaggtttgtgttagtttcgtcttgccgctataacaattcaccataagcgtagcagttaacactgatttattgttctggaggtcagaagtctgagataggtctgcagggctgtgttccttccgtcgactctgggggagaatctgtttcttgccttttccagcttctagaggccacttctatgcctttgcttgctgttctttctccatccttgaagctgtcagcctaacatcatttctcctctctgccctcttgcctccctcttataaggacccttatgagtacatggggcccacccggataatccaggatcatatccccagttcaagatccttaatcacgttcacagtgttctttttgccatgtaagataacagattcccaggttctgggtattaggatgtgaacctctttgggggctgatatttttgcctactgtagagttttgatttggggcagaggatatcagggtgtgtgtgcagggatgtggtctgagacagcatttgggagttgaggacaggaagaactcatctgaccagtttggctggtagatgagaatgttcatattgagattgacaaagactgcaaatgccagggtggcttctccagatctctctattagacttctgcccttctctccaagagacacattccataatagttaaaatgaacatagaacaggaaactgcttaaatcttatggctttagcagaatcttctggctctccacacacctgactcaaagtcagactttcctccctcgggggatcaagcctgtactatgtgaaggagtgttggccggtcatgttaaccaaaacatacacatctattgatctgatagtttgagttatctttcagtaaatattcactcacctctgctactcccaccctttccaactgtgggacgagtggcttcattgatgttgagcttgcctgtgtgacttgctctctcaatatggtattagcaagcttgacatgagggaggccttaagagctcctacatgggttggcttggctcggctctggtgcattcatcatggaaagaacttactctgaggggctaccgctccttcaacctggtttgtagaataagcatacatcaggcagacctgggcacaactcatagcctggagccatgcctggctgatccacaccaggagattatacaagcagatgtatgagcttgagaataaatgtctgttgctgtaaacccgtggctttgggggtgatttgttatacagcactatggtgacaacatcccactaacaatgcatgcatataattttatttaaaccctacaagaaatgtaggaggtatgtataaatataaatctggggccaggaagggtaaaattattttttcaatgtcacacagttcataaataagttttaatgtgcaagagatagaaaatgtgaaaacatcaagtatctgagcaagactatttgcagatggaggaagatggaaagtggaaaaggcatcgagactgatgacatttaaggagagctctatattttgtagaggccatccttagaaggctaagtcaaaaatgaaagtcaaggaggaaaagtagctatcatttttgagattctgatatgaagaagtatcatttggtggcttatgtaaaagcctgtgctaggattgtgtctcacaatgtcatggccaagtgtcagcccctattagaggggtcagtcaggaaacagaccatgtgcattttaacccctcatcttttctgagaggtgctcaacaaggccagcaggtacttcgcaagtgagtgaggcaagcagtcagataatgtgtcttctagctactgttgtactgtgatccgtgttctactggggttccattcttgtttgccacaagttaactgagatggacagctttgttttgtcaattgcctttttcattgcctaggtaagtcccaaatgagattcgacagaaaataagcctccctcaactgacagtggttttcatttgaaagtgttccttcagtttaatgacactcttgtacatttcaaagaataaagctttggacatcataaaaaagcttggtaggcatttctggggctgctgacacagcagggctcttcaaggtccagcagtcctgagtagtgtctgtagattaatgtgattccttggaagatcaagaatgtcctgggatgggggagttgtcagctatgagcagcctcagctttgaaaaaccctggatctgaatatgaaaagccaaattctccagctgaaaaaaaaaggtagtacttctagaagggaggcgatcagagtccaattaggagatattacttttgtttgtttttacatagtctagaaacaatttgatttacacatggcttcttaggcagtaatggcaaattagctacgctgagacttttctaattccagtgccctattgttcacagccaggacaagtaaagtgttagaatgtttaatacctcaccagggcccagtgctaggtggcttttgaccatcagaaatgtttcaggttttattctttctccagcttttcttcttttcctttaatttctttaaatgaataaagcgacttgccatgaatcaagtgggaattgaagtgaaactaacccagatgttatgggtttgacttctccttttcttcaccccaaatcttttttcctttctctggaaactgaaaccacgtaatttcaaaattgcttctcttttcccaacccgatttcctctagcgcaaaagtaatttttaaacattccaaagtctctgtcttcaggctgcagtcttttgcctctgttcctttaattcttcccagcatttgagcacttgagcagttgatgtggcaggaggcacacagctgaccaccctgctccctggctcagccacagtccaggggactgcatctggatggggcagagagggaagatcaaggtctgagatggagctgggaagcagaatgtggcagctaggaggacatcagatttctgggcatgaggtgcctaggctgagtggaatactgggagacaaagatgggaacgtggaatattaaggaagtttaggcagtggggtcctgcatcagtcaaggtctattttggagataaatcatgacacttataacagacagaattgcctatacagaattgttaactatcctggttttcaaactgtgttgagacagtgtaagacaccactcttaactcacaagagcaccggtagtaccagtatcgtggaaaacacagcatcatctgtcagacacgctacaaatgactacttgaaggggcccagagtttcaacatgagattgggctacattccttctgatgtcatatcttggcagaattgggcttctggcaattgccatgatgaaatgcaagttttgtgccaaaatcaacatggaacaggcaacgaaagtggcagtgtctgtctaatctgaatcttcagtttgagaaattgtgtaatgctcaacagatacatgcatccttttagggagtaattgtagttaagaaagaaaaaaatagctttattttgatttgtgtgtactgttttctcaaaccacttcttatttgttaggacgcaaatacttattaagttgtttgcaacaactaatacatgaaactgttgggtatgttttttggcttaggatctgtgggaaaaaaaaattaccaaaacaccaagggcactgtgaacctctggttaactgtatataaagaattgcctagaaaatggaaaacattaaaagagaacatgaaaacactagacaaaggtggcaactgtggggagcagctactgccagggttgaaaagaacgaaaagaggctggtgctggtgtctctgaggtgctgcaatgaggctggctctgtaagtgttggggaaactgcaagctagatccaaatgctgtgacagaatgaactggctacttggatacctgatgctgaagtctccccgtcctcctgccccgcaggctccctctatcgccccctatgggcagatactagcatgcagccagacagtagagcacatgtgatttgtgccatcctagccttagcaccgtaaagcaagatacagagggcatgtttggagccaaagacaatggctgaataactggctgaaggcccttgggctgcagtttttgtgcttactgtgggcccgagggccatgacctcagtcaataggctgctttgtgaatctggattatatttgactctgggttccccctctgtaccccaaactgactggaggacctatgggatagggctgttggactagccctgattggacccaattttacattcatctgagtgggatggggtgggacacatacccaactgggcgagagaagcttttgagtgacagctttctcggaagaactaatgtttaaaggaaggcctaaagaacgagtggaggctggacacgatggctcatacctgtaatcccagttattttgggaggccaaggcgggtggatcacttgagttcaggagttcgagaccagcctggccaatgtggtgaaaccccatctctactaaaaatacaaaaattagtcgagcgtggtggcatgcctgtaatcccagctatttgggaggcagaggcaggcgaatcccttgaacctgggaagtggaagttgcagtgagccaagatcacgccactgaactccagcctgggtgacagagcgagactgtctcaaaaacaaagaagaatgagtgaaaactgggagagaagtgggaatagagagggaagagtgacacctttcagtccaaatgtcacctcttcagttgtcttctctgactactgtacatagcttgccatttttatccaatcgatcccttgtgtttccttcagaacactttttatttgcattatcatcatattataacatctatatttccttcaaaacacatgcaatttggttagctcatgtgtttggctgccatgatggttgttttagtctgtttttctcaccagatttagtgcaaaggaggcaggaattatgtctatttttgttaacactatgtcccccaaaactagcttgccaccctatagatgctcaaaaaatatttcgagctaagccgtgggaaaaaaagtaaaaacttcagggtaaatgaagaagaaagatcaggaaagatcaaggagctgatgccaaggcctcaaatcaaagaagtaaaattgtagacataagcctttcccaaccctccagtctctcttccctccttgatttttctccacagcacttactactatctgatgtgttacatacttttctgatttatctgatatattatttaatctcctacccccactagaatatatacaccataagggcacagagggtttttgcctgtttggttcactcctacatccagtatagttctcagcacatggtagaaactcaaaatacaaaacaaatgactctgtccagtgctttacttttggcaaagaatactcttaccatactgttacaactgccctagttgttatcctcattttcttcttagggatggtaggaggaccaatgtgtaacacccagactggcctagcacatcactatggggtgtgcatgtgtggtgaaaggcagggattcctgctcttgtggacggtccactcaagcatggcaatctctgtggccattagcctccttgctcttgtctcttagattttaaatgtgctgcctcctttatctctggcttaatcttcccgctcccttttctccctctctcgtccccttctatacacactcttcccctttacctggtttaatcctatccatcctttgcccaaggtccctttttcaggaaagaattcttggcctctagactaaatattacattgttggtaatttatctcaaatatttaagcttacacagtggggtgtgatgggtgagttgtattggtcaagctattgagagctagtaccggtattaagagccttacaatcaagaacacaccataagtacactagtgttgcagtcaagaacccatacctcagagaaaactctaagtacaccacatgcttttgatatcatatatcaaaataacatatgataaccatatatatacatgcgcgcgtgtgtgtgtgtgtgtgtgtgtgtgtgtttgtgtgtgtatggtttttttcttttagagacacggtcttgctcttgctctgtctcccaggctgaggcaggaggatcacttgaggccaggatttcgagacccgcttgggcaaatagtgagatacttgcctctaaaaaaaaaattaaaaaaaactaaccagatgtgatgagtacacgcctattttcccaactattctgataccatatcttgatcaacaacctccatgttgctaattagcaaactaaatattagcaattgattactgtggttgaaatcaagggcctgtggactagcataataaatgttagaagtaaattctaattggtgaaatgaaaggtatttaaactatgtgggttggccaaaatggttttaaaatactctccagaaggacattataaagaataatcctgtaagacctctagtcttcgaccttagggatggtgtcaaaaccttgattcctaaacagtactgtgttagccatgagattaggaggattgccggctgcctaaagtgacaatcatagtcatttattttacctccataacaagagtaagcatgctatagcctaaggttctagctttttgtaaataaacatttattgaaactcagccacacctattttgcgtacatgttgtctatggctacatttgcactataatagcagagatggaaagatgcaacagagactgtctaacctgcaaaggtgcaaaaccttaaatatttactatctggcccttaaaaaaaaaaaaaagctcacctacttctgccttagagtattgttgtacttgcctcgaatgaacctttcatgaaaaatggtaactgattcatctattgctgggactttatgaaatagattgtttgagctgttttgtgcccatttgctaataaatgcttgtatactgtgtccatctgtgtagtagaatttggcctaaggcttgcttttattatcatctaataatgcagttgttggggaatcgttaatcctcgttcaccttaaatttctttgatggctttggtttctatgataacgaatgtcagggttgtgcatgcgtcatcatcaaattggcttagctgggtttcaatgctgtactgtatctattgtccagaagcccagtacttcccctgcaaaagacttatcaagcttcatcatatcatccttcaaaattattgcatccccctagcatcagtttcacaaaggcaagcaagtgtcccattcacctacatccctaatgcctggcccatctcagaggttcaggatatgtatgtagaatggaaggagtagatacagcaataactgcaagggcattaatggaagctttctaacactaaactatagttggttaaaagaatgaggccagtagtcaactagactcagaaccaggtcagagatccacagaaacctccacaacccctgtttgtctcagtggctgttctgtctcacctcccactctgggtttgagggagtgcaactgtatttagtaccatccaaggctctggaatatattatcttcttaattcacctcatagccctaagagtgaaggagtatcatctacgtttcctacatgagaaaaataaggcacagacacaggtagggtaagtgatgtgcttaggttcaggtgatcacagaaccaatgttcttttccccatgtcatgatgcctccatgctcagtgagtagttttcaattaagaaatgagacaatgaacacgtgagtggattaccttctctgtggcattgctatgggagggtagcaaccgtgttgccttctcacaaggtgacatgctccagcttcaggtgattctaatcatcagcacgggtaggatctagtgcttctatattgtggaattaccagcatctccaaatggagctcctggattcctatgcttgcttatatttataagatatctatgataatacaggctgaatatcccttatctgaaatgattgaaccagaaatgtttcagattttggaagatttgtgttatacttaccagtcgaacatccctgttattgaaaatctgaaatttgaaatattcccatgtgcatttcctttgagcatcatgctggcactcagaaagtttcagattttggaatatttcagatttcagatttttggtttaggaatagtgaactagtattcaacaaattcttgtccaccaaacatctgcaataaattagaagaggtggtggaaaataagcaagagagtgggtttcgatgatgctggaaagaagatggattttatttttgttccccttacctttttattcccttcgtgtatcatttccatgcagaaagtgcaaattaatggtcacatcgaactatctgtcaacatatttctgctcttgcagtatcaaattatgttggcaataatgtttccagctgcctaggactccattgcaatttaatttgaaaagaactcaaattgcatctccaaatggataaaaaattaattttgcatacaagctatccacctccacattttcagccccatccccaaattatcttaatttaggttcaactttgaacagtacatatgctacaggcaactccacatgcaaacatgaatacgtagcaaattcatgaattgaaaatctgttttgctgcttcttttttaataagatgttctgccttgattaaggtcattagaagattctacagctattgcctttgacagcagggatggaggctgagtccatacagaacaaaaaagggagccaattctgacttaaccacatgattacccttaacaattggagtgtaaggagatcctgattcaaccctctacttattgcttttcccctgccctctattagcacctaaattcgggtggcttggtcttcagctatcactactttctagatttattcatttatgtacttattcattcatttattcagcagctgtatgttatagttataaaatgaggagatctaggggctcacaggttggcagtggaggtgaacatgaaccaaacatatgaacaataaccctgaagtctgataagagctatgggagacatatgatagcaggttaaggaaaaaaaatgtcatcgaggcattaattatgggcaagggagactgttagagaaagtcacaagtaaagggtggcattggagctgggccttgaaaatattgaatgaggatttgttggtggcatcccaagcagaggaaatagctgggcagaggcttggaggtgtgaaggcatttataatcccttgctttgctttaagaatacaggatttgataagtgagaagtggaaaatgactcaggggcatttgggggcaggaaggtacctgttgcagggtgggctcgggtattaggatgaaaatggtacttcaggatggacatggtgctttaataagagctgatgtagaaagaggagcagggttcagaggtgaggaggaccaccgtgccttcctgaggccacagtaagaatggagaaggttctgaaaacctgagtgggtcagtcacacatgcatgaacacaagcctgtccctaacatgtgcataatcacagaatctgagataggaataaaaatgtcagcccgtggccccttcccccttctcctttcacccaacaacatctctccccacaagggccccacatatgtgtgtgcacagcaacctcagtcctcaggtgcaagttctgtccactgcccccagacagccatcctttggccatccttaggccaacggccactcacaggaaggacagaacaaaggaagaaactgagtgtagggcctcgtggcagggaattctagggggtcataaatgtggagcctggaccagaagggagaggacagaaccagatcctttggccagcccattggcccccgatcccttgctccgagaagagggacagtctgaagtgggccaaagtggctctctaaagtacagggcataggacaaggccactgttgtctagcctaagagcatacagaaggtgcatccagaggtagagccactttgattttctatcagaggatggttttccagcttcccagacaagccacactcttcccactgtttgtcatcttcttggcctgtgggctattactcaagaaggtcatacggacagggctttatctggaggcagaaaccataggctctaggcttggctgtatttacacgggggatgtaaattcaacaaaccaatctccactgcacacacaaggctttcttagcaatttccaacttgtttgcaccaacccgaatgtaaaccccagattctccatgctgcaggcaattacccagcagaagctgggtttggcagatgaggtttagaggggtcggactgaaagcatgaatgcttccatcacactctaaaacctagtttccattgaataggatttcaggatattctcttgcttgaatgcaaaaaaaatatatatatatatattacccttaaagacctggctgacatgctgaaggggacagaacaaggactgtggagtcagagagtctgagctcagttcccaagaacaggtcaccatctgttcatctcacaggaactgccccttgacagaccctgtgccacgttgtgaggttactggcaaacagaacatggtctgttgcagcctgagaggggggacaaacacatgaacaagcaattcctgggcagtgtgacaaatgctaagtgtgtgttggacaacagtgcaaagtgccatggccaaagagtggatgtctgggggaagtggacagagcttgcacctgaggactgaggtcgctgcacacttatatgtgaggccccctgcaggaagagatgcagtttggtggaaggagaagggggaaggggctacagactaaaatgtgtattcttatcccagacccatctgtgattttgcacatgttcgggacaggcttgtgtgcatacatgtgtaactgacccattcatgggagcccagagaatgggggctcggccatgtggccctgggtaagttacatctcttcactgagtctcaacttcctataccgtcgagttgtttttaggacacaagtgctaagggtagctcctagcccagagttgctacttaatagccattgtctttccctttcctgaatgcgagttctcagatttacaaaatgctttcacctgcaggtaccgaatctctaggttcaccagagtccttcttgcctttggaatacaaactgagatttccttgaatctctgaattttcatagccagtagaaaaatcatctccccaaaatcatctcccaagatttcagtaacacacatgagcacattttccaaggttcctttgcctctggtccctgtgttcccacgtggtatcttattaggcccaaggcatgccgacctcaaccctttctagaacccacaggagatccaggcacagcaaaggtctttgttgtattttgagggccttgctggagatctaaaaatcacctggggagtgatcatattgggcttcacccaatattctgccatttgttcaccctcacacctctcttatgctatccaagcccccagtgggtttattttttctcttccactggagtctcagcataagtgatactgaggccccaagaatgcagcttctaccccacacaagcttccaaaggcatttctccaagaaaggcaattctctctaaaaggagtacctactgttagccaaaggcaattttctctctctttacagttcattttatgctcattaacaaccttttgagactagtgtaataatttccactttatagatgaggagatggaggctcagcaatgaagtgcccttgcccaaggtcacccagatagtgagtgccagagtctcgcttcaagccacgctctagtcagcagcactgtacccggggcccgccgtgacagtcacacatgctcaagagggaacaagtggcttttcctgtatcccaactttcccggtctcaaagagtctctttgctgtgtggcaagatcacgatatccttgtcttctttaaaaagatgctcctgtttagtcctttaagaggagcagaaatgtgtgtatatgcacacctccagaggtgagctccagggagaatggagaccagggatcaaaaggccagcggtcagctttgcactaaatgtgtttacatcactgtaccactctctcccgcaggtcctaggctcctgagacccaagtcatttttgccttgtagtattttggctttctctcactattgtcttcaagtctccccagacttctgatgaaggcgacatgcctcatatttatgttctttccctggtctcagtctccggtggcgtcaaggtgctgagaaaacacaggttttctactctggcagacctcatatcttggctgtgcctctcactctgtggctttaggccaattattttgtctcaaagagctttggtttcctctaggacagagctagtgatgccttcctcccaggtagtgagattttcaacatagagagtgcaactgatagcttacagagagtttttactttgcacactacatgtggggtcaggcagacacaagttcaaaaccgcactttgtcacctgctggccttgctactctgtactaattcctgcacatttctggacctcaggttattcatctgtaatgtggggtgggccatccttccctcctagggtcataagatggttcagaagatagagcccagcacttgtggctacagttccatcagtggtgttttgtctttatagctttgtttgtgggttaaggccataataaagacctcaaaaattatatttaacatgagatatggtacattttaagatgttcaataacatgtggtcttagccttgggtttaaatgggtcttaagtgttcctcttctccctgcctcaggagggaggtgagagtgccatgtgggtgactgttgtattggggcttggcatcagtttggagggcaaacccaggggaggagtgtcgaagaggccctgagcaggggcagtggctctctgccaggagagttctggcacctggacaagtggacaggccccagctaggcaacgctgatggggatgctcggggcttcccaggcaagccatttattgctctctgtgtgcctgtacatctgctctcattgcagtcggtacaactgcgagatgtttagccagcagccgtaatcccaccaatcataatccccagctacagggaccacatttcaccttccattccacaataggccctcagcaacagcttgttcaatgtcacattctcagggtcacccatttgatttggggatgctggctctgctttgcccaaaggacctgtgagcatgaataattgggctgtaagagtgatcatgaattcctcagttgatcaggggccagggctgcccactatcctcaacaccctcactcctgcagccacgtgggcagctctgtgcgggcttgccaggttccctgacattcctgtgaactatgttccttggtaggacgccgacacaagttacaggatattttccccatagggacagatcaactagcaccaatagcatcccctctttcttattgctgcattggtgcagaggtagccttacccttaaatgctctgaggggattggagcaatgatggaaacctagtccatcattttgcataagggtgctcccagcactgccactcacaaggcattcaaggtagacacagcatgcggaacactattattattactattacatatatattattactattactgcaaaacaaacaacacaccccagttatcatacgtagagtgcttattaagtttgagttctaactgctttacaagcatctcatctaacttcctcttccccctgccatgaggttagctactattattatcatcattttacaaatgaattaaaaagtggatccaaagaggatacataattgggcaaagttctgtaggtatggggagaagtactgatttaatctccagcctgtgcctgactcctcccagataagaaagtctgacacaagaatttctgggtgtatctatcacatgagaagttatgtttctaacataacaaatgcctgacccaagagccaggcatggtggatggtgcctgcaatcccatcactttgggaagccaaggcaggaggatcacttgagcccaggagtttgagaccagcctgggcaacatagagagaccccatatgtgaaaaaataaaaataaaaaattagccaagcatggtgtaggcccacctacatgtgaggctgaggctagaggatcatgattgcttgagcctaggagtttgaggctgggatgaactctgattgtgccactgtacaccagcctaggatagagagtcagactcccatctcaaagaaacaaaacaagccaccccaaagacaaatgcctaaacctcaacataaaatgagctttacatgtgaggatttttgaaaaacatcatgtttattataacctgttttatattaaaaaaatctatttaatgtgcataaagtataaatagaatattcctaataaaattagacatagacaacattatgtatggtgatctgggaccaagatcaataggaggcatggagtgggagacagcattagggtgagaaggcatgctcagattagcttttagaatgatgttcccagagggaccaggggagaaaaagagggatggaagactgttgtaggaggttaggaaatgatgaactgtgtagtcaaggaaaggagaggaaatcctaaagcagggttaatgggtcatgatgaacgcatggataaactgggtgttgcgggttgaggctgtgactcagtttccagctagtgcatctggatgttgttggctgaagaggagaggctgacctccaaggggacaggctggggctgaattcagtataaggaggcaggtcagctctcagcagccgtctaaataagcgtatcccagaagcgaggagtgtgctgtgtgtggtaccaagaaggttttcagtggcactttgatgcacccttaagaatttaacaatttcacatttatttttatggttaacatttatttaagatgttttccttttatatatttatgttttctattagatgcatgtatttaaataagacaagggagattgatgtaaagaaaaatgttctctaaattatattgcctgtgtcaaaaatcatgatggcagtgattgaatggtggagatatgtttggaaaagctgtgttccctgttgtagcagaacatgtaccccagcttcccgatggtctcttcagaacccttgtttcttgcctgcatgttttgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacggtgagcaagggaggagagcttacatgggaatggggatattgaatctattcacagggccatggcagtcagttatgaggcttttatttttcctacatttttaattccctcacacacacctttcttttcttaggccttcaatgaaggactatgtaaactgtgcattgcacaactccagggagtgctttcccatcacagtgacagttctgccatagacttgcactcagctttggcccttttgtacccccatccctcttcttgctttataccagtgtattagaccattcttgcattgctataaagaaatacctgtggccaggtgtggtgactcatgcctgtaatcctagcactttgggaggctgaggcaggtggattgcctatctcaggagtttgagaccagcctgggcaacatggtgaaaccctgtctctactaaaatacaaaagaaattaccaggcgtggcagcgtgtgcctgtagtcccagctactcaggaggctgaggctggagaattgcttgaacttgggaggcagaggttgcagtgagccgagatcgcaccattgcactccagcctgggcaacagagtgagattccatctctaccaaaaaaacaaaacaaaacaaaaaaaacaccggagactgggtaatttataaagactgggtaatttataaagaaaggaggtttaattggctcacagttctgcagctgtacagaaagcatagcactgacatagcttggcttctggggaggctgaggagcttttactcatggtggaagatgaagtaggagcaggaacactacgtggccaaagcaggcgcaaaagattggcggtgccacacacttaaccagatctccggggaattcactcactgtcgcgaagacagcaccaacccatgagggatccacttccatgatccaatcacacctccagcactgaagattacagttcaacatgagatttgggaggggacaaatacccaaactatatcaaccaccttctctgtccaaggtttgactgcactgatgcctccagaaagataaaacatgtatcacattgtttaaacatgttgaatttggaagtcagacaatgctgaattatgtaagaattaaaaacagaaaatagatataaaaagcttagcgtacacattggatccacccagaactgaatattcatctggctggatgacagtcatctcaagctcaaggtatctgaaattgaactaatctccaattctatactgactttcctgtattccttatctcaatgaactgcacctagtaactcaagatagagacctgaaagccagcctaggagcctccatgtctccctcccaaacccaccccaccttcatacccccatttctaatgggtatgcttcctgcagtttatcttcctcataacttgagactccaagaacctagagccactactgctagaacacataacttttcctgcctctctgtccttacccatgccatttctcctgcttggaatgacctgtcctccatgtttgcaaggaaacctctattgacctttcaagtctttgctcaaatgttacttcctccaggaagctttccttgattgccccagattgacttggatgtttcttcccaggctcaccgcagttaccttagtgatagcatagaattcgccagttccagggcttacctaagaaacacttccccatgaccatatttcagtttcccctccagccagcccaggctgcctcttgccttgtgggatggctttagatagttcctgagaatcagactcagatgaagattcgtgtgcatgtgactgattaagaaagttttcccaggggagactgggaggggagtgagggaagtgggacaaggaaggggagaaagccaaggtgcaacttttggccaagtccagcaaaaactggctgcaacctgagccttcagggaactgttcagggtgggccatgcatcacagatgtcctaagttaggcaaggaagctgccagccaacagttagggtctgggatggggaggagagattcagaggtaaaatttcagtaacttttgtctctctgcatgtgcaggtaaaggatagagtctcacaaaaattgtataaagaggtctgaaaggtctagccagagcactggcattgtcagctgcataaagaaaatacccggcttgactcagattagccttagaacttgaagacagagcctctactgtggcaattctgtttaggacatgttttctttttttcattttcattttcttctttctttgtgtgttcctgggattcagtaggatctagtactcttgtttcatctaagcgagttctaaatacttcagagttatgaccctgagtagaacccagattcacattctcagctgcaaaatctcatgagaagacaagggaaatagtgccagcctcttctcaccctgcccctaattctcacttccaccatgtcccatcctagatctggaagttttacacagtctactttgatgatccatccctcccttacacccttccagttcatcctcgtagccatcctctttgcagaccccacacactggtctttggggtcatccttggagtagactctgtaaaacttccagttctaggaagatttccctagatctgacttcattgtttcagaaatctgtagccccttcctccagcaggtagaattgtgcgctgtcagacaatgtacactctggagccaagcatgcctggacaagttgtttaacctcttagtgcctttgtttcctcatctgtaaaatggaattaattggccagacatggtggctcaccctgtaatcccagcactctgggaggctgaggagggcagatcatgaggtcaggagattgagaccatcccggctactgtggtgaaaccccatctctactaaaaatacaaaaaattagctgggcatggtggcacatgcctgtagtcccagctactcagaaggctgaggcaggagaatcgcttgaacctgggaggcggaggttgcagtgagccgagatcgcgccactgcactccagcctgggtgacagagcgagactctgtctcaaacaaaaaaggaataattaaagtacttatcttatagattctcgtgcacattaagtggcatggtatataaagaaattggactaatacccagcatgttataaggtactatatttgtggtgaatcacaggagaaaaaaaaaacaaaaaggtattcacaaaggagcatctatccccggcagttgagaaacttcccagctcccctaggaaacctcttcagagctgtagacatgtccagacatctagaaatctaactggttgtgggaaatacactgtagatgctcaaaaagtggcagtgtgcttggtgcctgatatgagaaacagagtcagggcaaaaggatggtttagtgactcatattcacagggaattcctggttgttagagagggagaagtcactgctgaaaatcagcatgaaaattcaggactcaggagatgaacaataaggttttcccaaggagcagctcagggcacctttttaaagattctttgcccaccttgagctgctctttgaggattacctccctgtgcctcagcaaaccccaagtccagctttaaggcgttccttaacttctctctttcttcttcctgtcaccaagaaaaaaaagcctttatcaaaacaacatgagagcaggaatgctttgaaattaaattttaattaaacatcattaataaagcatcaattcctgctctatggagatgtgtggacattatcattactaaaaacaccaacatacgagacatgattcctcagttctgtattctgaggctctgcctcaaaacccactggactgaaggagagtctcagtgtaggaccctgctgtatgccagggttaagttccattctttctaaagagagaggaagcaccacttctgttggctgggtaactcgttcacctcaaggacaagatgaggctagagcgtggctctagtagattaactgaaacccccctccgggagccagcaagcaacctttaggattgagttggctgaatggctgaattcatgctgctgtcatccgtgccacaaaattgtcttctggggaatttgcagaatttgtaatttcagcacctcagtgcatttgacggcctgcgaagaaatccagcactagagagcagctcatggctgctgagccccatggcttcatttgggtagcagctgttcataagaaactaaacagattctttatttttcccttttccacaaatgtctcagacaaaaccacagttcgcttgcaccttgaaagatgaaaaccatgttgatggttttgcttggcagctcactttgactgctatttattgagcacctacactgtgctaggcacggatagacatattatatacagtggctcctgtactcctttagcccaagattttattgtgaaaattttcaaagctagaaaaatcgaaagaatagtacaaaggagacttataaacctctcatctagattcaacatttgtaaacactttgctgcatttactcatgtgtgtgtatcttatatctacatgataggtgacatatgctatgtaaatatatttatgaatacatacaatattttaaccatttgaaagtaaagtgcagaaatcatgacagttgatttctaaaccaattagcatacaagacctaaaaataagaactttatgctacatacccacaatgctatttaacctctaataaattttgcattaattttaaaatcatgtaatatacagtttgtttacatttctaataatatttaacctgattctatgtgacagaaccagggttccgtatatctttggcaaaaccattatgttggcgatgtatatttctcattgtattttgtcaagaagttcataatgtcagggagtcccagtactgatgatgtcacatatggtcacttagataagacaagaactgcccggtccctccactgtaaatgtggcaccttttttcttttgtaaagtatccttggagtgaaactttgagatggaatgagtattgtattcccctaaagctttcactcaatggttttaacacgtcctgagagtcttcacctgaaccagttattacgttggtgcttacaaaagggtgatttaaacatctataattctccctacgcttactagttagccttcttctttagagaagagttgtttctctcttcatcttcctccctgtttttggtctccctgttgattcatagatcatttttgactccgtgtattgaaatcctctactgccattctctgtgatgctcaaattgcctcaaatatggccagtggcagtctcttcaagctgattcccaggtccttttgacatgttctcattagtcttccttgcttctggcacaacaaaaatattctagactattcttttaatgtccctgccccagacctgaggccaaccacttattagggatttgtggttgctttcaatggggagtggtattttggcactaagatatacatcttaggtgtgctcggtgatgcgttattgcctgtaggttctttcagtaggtagagctagggagtataatttatttttgttttaagtcatgagctcatactgattcaaattcaacacattttatacatatatcttccttctcctgcagtgagaaccctggtgctcaacatccacatagttttcatttcctgaaacacacataaaatagtttcagaattacaacaccaatccctctaaaaaacaataaagctattatactaagttaggttaaagatttcagtttttatctccttaggctgtataccactgagggtatgcagtgagaatactatgttcaaaagttcagttcttttctctgtatggttatattatcaatttgatacccagttatgttcatttgtttccatttaaaggtttgccttccacctatgctttttaattcaatttaattgtttttaatatgcaaaacagttgcatgtttcaaaagtaaaaactgtgtctcattactgggtatatacccaacagaatataaatcattctattataaagatacatgcatgtatatgttcattgcagcactgttcacaatagcaaagacatggagtcaacccaaatggccatcaatgatagactggataaagaaaatgtggtatttgcagccataaaaaggaatgagatcatgtcctttgcaggaacatggatggagctggaagtcattatcctcagcagactaacacaggaacagacaaccaaacactgcacgttctcacttgtaagtgggagctgaacaatgagaacacatggacacagggaggggaacagcacaccctggggcctgttgggggagtgtggggagggagagcatcaggataaatagttaatgcatatggggcttaatacctaggtgatgggttgataggtccagcaaactaccatggcatgcatttacctatgtaacaaacctgcagttcctgctcatgtatctcagaactttaaattaaattagaaataaaaacaccattaaaaaactacattaaaacgtatattccaaaaaatattaccgccattcctgtctcttttcactattccaatccacacttgaaaggtagctattttcattcctttctggttgatctttcttagagttctttttgcaaaaaaatatgtaatacttttcttcttcctacttcttatataaaaggtagcataattgatatactttgcatcttgtgtttttgttcactcagtatatcctagaaatcacttcatatcagttactacagaatttgctctttattttttatgacactatggtatttcattgtgttgatggaaatactgtaatttattcaaccaatatccagtggacacccaggttgtttccgttatttactatcataaataatactgtagcaaatagcattgtgcatatgttgtttggtacttgtggcaatgtatctttagggtaaattcttaaaagtgggattgcaagagtcacagagtaagtacatatgaagttttgttagctgttgagaggtactcttccatagaagttgtatgattttgtgttttcactagcagtgtagattcatttaatctgaacactaaatgtgaaggagcaaagagtgtttttttttctattttacaaataaggaaatgtagaatcccatataataattacatataatgtaattgattataattaataacttaatatataccataatattattgatatttaatacagttaatcacatacaaaacatatattatttcatttagcatcatactttttaaaaaactcatgtacttgaattgtaaggaagactgacatgcctcaggaatgagtacctttattaagtgtacatttctaatgagccaatgatcaggtttctcaggtcacagtaagctagaaggaggctgcatgttgctaaggatgagtacatctgtagtaacaagatgtggcatgtaaaaccgggaaaagggaaaagtgagagaaaaagcagaaaaagcaataacaacaaggcaataagtaaagcagtccagagtcatttagtgtaagagtgaaagctattcacaccttagtgagtcctgaaggcatcactgtattagagctcagtacatttgagatgtttaccaagatggtcttgagatattataaagggcaaagagaaatgcaattatgtttttcaagtgcacactatgaactaggcattgtgctgatactctccattcttacagtcaattcccaaatactttgatgtagatgctatcgatacagttgtgcagaagaggagtaaatagaattcaaaatcttacctgaagggcattccctgaccacccaatatataattctatacctggccaaaacctctaccgctgttctctgttttatttttctctacctcatgctgtatattgattactttattatctctctttgagggatataagcttaatgggaatagaaactttgttttgtgttgttcactctggtaatccatagtatgggctcgttgttgaatgaatagatggatgaataaatgaccattccacataaaagttcatgcccttttcgtgataccatagtgtcccatttatgggtattgtttgtgaagatgggggatatgtatgacgtcttttagctatattcaaagctaactcagacttgcttgcatctcttcccacctccaagttcagtagtaccacattcgttgcttcaaataaaccatggtggaaatatttacaccatggaagttggcaaagtttttgtttttatttttccctggagagcaggttgtgaaacatttagtagcatacaactgtatagttcaattaaaaggctatagttaattaagatgtaaagatttatctggaacaaatgtattttctccaacacgactaggaaatatgagactaaaattatctaaatctctcttattaagttagttccaagcctctgtataatgaatgaataaagaaatatggcaactgaagtggagagacaaaaaaatgacatagacaagtatcaagggaaactcctgttgaattgtacatggctatctgcttttatatatactaccttggtattcctcatatctacccccaaagttcaccattgttaaccccttttcagatgtagaaatggagataaagagaggagaggaggggaggggaggaaaggggagaggagaggagaaaacttcccttgataacactctgtcctcctttatgttgaaatgaaaatcttccttaaattaccacctgactttaaggcacaagaaaacatctggtttaattacagtgaatttacatgaacccactgacaagaagcacagttaaaattagcaattttagtgtgcttttttttaagagaatgaaattataaagtaattaacctttgttgtagaactctgtcaaaaggatggaaagttccatgctgttaaatagaagaagaaatgaaattgtggaaagggaaaatgtggattcattaaagaattacaaagaaaaaggaatggaaaagggatacagaattagaagataagacaaaaaaaggaattttttgccgagaagtctttttacaatgagagagagagagagacctagtttaatcaaaggaaagtaagtctatctccttgcaaaggacatcttgactatggaatggtaatgtggtgggtggaaagagcctcttacttggggtgagacatcctgattttgctgcttaaagatgcgatgacagccttttagccttctggacccacagacctaccaggtgatagaagaaaggggtgatttgggaaatgccttggaaatagaagagtttgagctatatccaggcttcatccactacttcactatgcaaccttggtttaaggactcgcattctgtacacttcagtgccccatctgtaaaatggctcgctacagaggctgtagcacatgaaagtctgtgtaaagcccttaacttactgtctgccaagagctttgctaagtagtgtgtggccaacatcagacatcatagagagctttttatttcagggtgttcaggaaaaaacaaaacaagagctctatccaaaatttccgtttgccctgggcaaaaggccacttttaaataacctctaacccctctgtaatctcattttaaacatttcactctgaccacatctcttctcttttcaatttattccctctagtattgtagctccaaaaattcagccccactaggacttgctaccttgttcattgccctcattcccttctctacccagcttaaattccttgactgatcattccagttacatccttgcataatcccccaacacctcagcctcattctcatttccagctattcacaaccctagctccatctgatttcctgcctgtgctaggtctttccttccgtagctgctgcacaccactgcgctaaccactctcacttggaagccagaagcaccactggagctggcttttaaagctgcctggcaatactgtctttccctggcccattcatccctctagtctcccagagaatatttctcctatcttcagactaacagcacatccacctgttctcacttccacagatgaccttgttacctaatagactgaggaactgaaaccattcaaagaaattccctccagctctcattgcccacatgttgcccacatatttgacctccccctcacctccttgtttctatggatgaaccatttgctttttaaataaaggccagttttgctacttaatgcagcaaatcccacttacttttttttttttaactcaatgtcattgctccagcaattgtcccctttccaccctacatcaaaatttccctttgtaactggatatatttctcaccctccacacaagctgtatttctcccatctttaaaaagattaaaaaaaaaacccagaaacacccagctctatcttctcctcaagctattccatcccctccttatgcatccattctttctatttgttcttgaatccattcaaccaaagtaactcagatccctgccattgcaccaaaacaattatttcaagatcacctatgaccttcaagtcaccaaatccaatagtcattactcagaaagtcagatcctcttacttaaccagttggcaatatctgacacagctggttgttaaatcctccttaaaacactttttgtactttgcttccaattcatcacacacttctagattttctccttctgcagtggcttctcctctttgtttttgttttaaagatagggtttcactgtgtctcccaggctggagggcagtgatatgatcagctcactgtatcctctgactcctgggctcaaacggccctcccacctcaccctctccagtagctaggacatgtgggataggcacatataggcatgtgcaagtgtgctcagctaatttatttgttttatttattttattttatttatttatttatttttgagacggagtttcactcttgttgcccaggctggagtgcaatggcacgatcttggctcaccgcaacctccgcctcccaggttcaagccattctcctgcttcagcctcctgagtagctgggattgcaggcatgtgccaccacacccggctaaatttgtatttttagtagggacagggtttctccgtgttggtcaggctggtatcgaactcccaacctcaggtgatccactggcctcggcctcccaaagtgctgggattataggcatgagccaccatgcccggcctatttatttttatttttactttttttgtagagacagagtctcattgtgttacccaaggtgatctcagactcccagcctcaagccgtcctcccacctcagcctctcaaaatgttgggattacagtttgctggttccttttaaacagcgtgtattagtccattttcatactgctataaagaactggttaaaactgtgtaatttataaaggaaagagctttaattgactcataaatcagcatggctgggaggcctcagaaaatttacaatcgtggcagaaggtgaaggggaagcaaggcactttcttcacaaggcggcaaaaaggagaatgaacgttggagaaactaccaaacacttataataacatcagatctcctgagaactcactcactatcatgaaaatggcataggagaaatggcccccatgaattaattacctccacctggtgtctcccttgacatgtagagattatggggattacaattcaagatgagattttgggtggggtcacagccaaaccatatcacatcccaaccttattggcccagttcttgggactctttcccattcgtatccataccagaggttggccaggtcttaaagtataggctttatccatgagagggtctgtagcagctactcgatgccaccattgtagcaggaaaacagccagggacaatggataaacaaatgggtgcggcagtgttccaatataattttatttacaaaaacaggcagctggttggattcaacccaagagccatagtttgctgaccctggatccacattcatttccctaattatttcttctagtctcccggctttaaaatccatccatatgttaataattttcccaattgatacctccaggccaggcctctgcccagccctccggagtcatttatccagctgtctcctcaacctctccacctagattgctaatcagcccgtggaattaaacacattcaaaactgagcctgtgatcctccttcaacttgttcttcccactgtcttctccatctcagtaaatggcaactctgttttattagtgtctcgagccaaaaaccttgacttctcacttttgtcagaactgaggccctggcttttacatctccaaagaaaatcccttctggctggggatggtggctcacccctgtaatcccagcactttgagaggccaaggcaggtgaattgctgggtgtggtggtgtgtacctatgatctcagctactcaggaggctgaagtgggaggactgcttgaggctgggaggtcaaggctgcagtgagccatgattgtaccactgcactccaggctgggtgacagagcaagaccctgtctcaaaaaaagaaaaagagaacctcttcaccctttattgcttttgattgagaccccctggctttgtacaaagcagcagtcttgctgttccccacatctgaaccaataacatattctcttggttcatcctgcaatgtatgtcaagaccttgaccatttctcacagcctctactactaccccttaggtccaaaccactgtgctctgcaccccagattattgcagcagcctctaaataatctttgcagcttcagctctggccgctgcattcttttctcaacacagcaccaaaatgatcttgttaaatcatgaagcaaatcatatcactccctctgctcccaaccctctgatggtttctcttgtcactcacattaaaaacccgaagtttcacggtagctcacatgctccaggtgaccagaattcccacttttgtttgcctctgtgtcatctcttgctacttgtgcctcactatgcaaattcagttatcattctcttcacatatatcagggacatccctgcctcagggcctttgcacttgccatcctttttggctacagtaaggttctgccaaataagcaggatggttccttcagcttcttcaagtcttttttccaatgtcacctctcagcaagctcttctcagaccattctattaaaaactggaagtctcctacagcacactctttgtccctctttccagctttgggtgtctccttagcaattatcatctgacatactgtatatttcactatatgttttattatctgtcttctcccactagaatgcattccacagagacaagattttttccttgtgtttttcttactctgcttcccaagcacttagaagaacagtgccaggtagacaaataaggacacaataaatacattattgaacgaatgaattctgagtcctcagagaaaaattagatttaagatcatttaccatagaaatcagaagaagatcgtagaaagctcagtaagctatgagaagatatagcttctatgattagcaatataacatcattcggatagagcagattgaggtaaggacatcacaggaaatagcaacaatcttaattgtctctacaaaaaaatcaaattagtgatctctaggctaccctagagctgttctcagagtgaatgcaatggggccagggggaggatcagacaaacatagtatttactttgtgccagacacctaggtaagcactttgtgtatattaacatatcaaatccccaggacaacctatgtagtaggtagtatttttatcctcattttaaagtaaggaaaatgagacacagagacattaagcagcttggccaaggtaatacagtggtgggaacaggacataaacccaggcagtgtggcttcaacccttgatcattgtttaattctacaatactgccttttaggtctcagtgatgacaataagacttttgattagaaatgccaatttgatcactcttcttaaactactgtcctaaagaaatatagagaaaaacacctttgtatctgcactgacaactgtaaaacgatgccatggctgctcctgaaagaattaatgcaagacgtcatgggagagggagtcccaaatgggaaagagatgactaggctgagactgcctggaaagaaaaccccttagggaattggaggagaagacttccaagtctacatgcataagtacctccaactttgaccaaccagtgctaaaaacaggagtgggcgttggagctggtggatgggagtggggaaaggagagaggtcagtgccctggtcatctttatttgctagtccatgatgcagagaacgagagctccccctccaagcctacgtccagggcatatggcaaacaagaaaaggggcttcagtggaaggatctcattgtaaagaaacaattacaggaaggggtagtgtctgtggtaactaacttcaggctgcccctcaaaacacctaaaaagccctcttgccacggagaatcttcctgctgcctaattatttcccttccttaactgcccctcataccactgccccacaggtcagacagaactcttatccagccaagtaatgtatgaatatatctaaattctttcctttccctgtgagttggaaatatttaaaataaggacttacatggtaactagcagaatgacccattaaaccagaccatcacacaccacttcttatgaggttgcatgcggaaaggttactggacagatttttaaaaatgctttcattcttattgtaaagaacaaatctgatagtgcaaagtaaataccccctaacaattgaagcaagaaacaagatttttaaaaacaaaacaaaaaaactaatacgcatgctcagtaagaatatctaaataaatcctgggatagaacatattcatggaatggaagttaagattgtaaaggtattagttctcccagactggcctttgtaaaagagtttagcactatttattattcttatttatttgatgataaactctattgtatttagggatatgtgcttaaggagtgaaaagtataaggaaaagcaaggtcacagtatgaagttcagtactgaaaaattaatgagatgattgttttatgcttttgtgtttatttcacagtaaccaagataaatgatgatagtgtatataatcttataccaataaatgtaaaatttaggtgatatggcaaactattaattaaaaaacttgacttaaggaaaagcaattctgtatagttttacaacaaataaagaaatagaatcagtaatttaaacttttgcaacaaagtacacatcagtcccaggtgacttcacaagtgcaatcagtcaaacactcaaggagtttgtaatcctaatcttacacactttatgagaaaggaaaaagaagaagcacttcccccttcaatttatgacaagactataaccttgatattaaaagcagaaaagcttatgagaaaaaaatgtatgcaaatacctaaacaaaatattagcaaatgatctgaaactgcataaatatgcaaaaaaatagtttaaaaaattagtgttagtctaactttagtaaatctgtttgtgtaatttgctacagtaacatactaggagaggggaaatacatatcatcactacagtagatacagaaaaagcatcagttaattctcagcatgatttaaaaaacaaaatattcttgtatgcctggaataaaaatgggccccctcaacctgataaagataactaaaaaacctacaaacatcatactcaaagatgaaacaatatcatcattatctttgaaattggagatagacatatcatcatttctattaaagactgtattggtggctatcattgaagataagaaaataaaagattggaaaagagcaaaactattattaactacagatgctacaattatctctacatagataacccaaagaaatctgcaaacaaattattagaattaatataagaatatagcatgtttgccaagacattaacattaaaaagtcaattccatttctattaacctaacaagtatgtggtattttcttaaagacattatgtacaatagcaataaaaatataaggtatttagtaatacatttaacataagttttcaagatgtacgtataaatctataaaacactgaaagacgttaaggaaggcctaaataaaagatataccatgttcatggatgagaaaactactattataaagacatgatattatctcccatttgatctataatacatgcaactaaaattcaaaaaccaaacattttttgaaaaggtacaagctagtcctcaaatgtttatgtaaagagaaaaggtaagagtacccaagacagtcatgaacatgaagtacaaagtagtagactttaccagatagcaagacttacacctcattgttaattaagatgtggtattgacacagggaaagtctaacagaaacaattgaatataatagaacatagaagtagacccatacatatgtggaaatgtgacagaagttaaaattatcaggcaaatcaactgaggaattaaaagtattttttcaatctccctaggatgaggagaaataattaaaattggattcctacctcatgttatacatagtaacacagttgtaaatgaattgaggacattttattaaaagagtaactcttaaatgtcaatgaaaatttagacaaatattctcatgacttcaggatagagaaagtgtttcttatgtaagaaaaactcttttgtgtgggtttattcagaagcagaccctgagataaggatacaaatggaagtagtttatttaggagatggtctcaggacacactcataagaaagagggaaagtgaaacaggaaagggaagaaagtcaatacaaagtttattaacaaaaaattaccatgtgaataactgagttctagaacagtgctattcccagtgtggtccaaggaccagcactgactcattgactctctaatccataacaagacaagtacagaaagagaaagtatttaaaaagaaggagcttagtatttttcttttttgctttttcaatttcacttttacttaaaaattatacttccctattaattcatttttattgtattttatgatatcatgagtccacaatggatttggaattatcattatcatcatcacaatggtttcagtgtttgaaatagtttgagaagtgctagtaaaacatgtctcagagtaacccaaccaagtagtaaggaaactgggatgttcatccatcaacttcctgtctttcattgcttgaaggatgtcttcggggcattaactctctggcacttcttgcttcttctacgtggagaacaagttggctcccacagcatttaggtaaatttgtactttgcagtaagcattattcagtgggatataggcaggccatcaacagtgtctgctactaaatttgtctctctctttctcccatacaaaaactaaaatctgatcaatttgagtacattaaaattaagaactgatccatattcaaaggtaacataaagagaaacacaagacacaaattaaaagaagtttttcagtagcacatatagccaataaaatgattagtatcaaacatatgcaacaggaaaaggacaataatatccaacaaacattaaaagatgctagtaaataggtaaaagcatgtaaaaccttaatgaagtattgttttacacttactagatggtctagaattttaaaacctgataataccaaatatttataaagatgcggaggagtaggaactttcagaacattgcttggggcagtgctgccaccactttggaaaacaatttggcattacactgtaaaaacaaagatagataagcccttcagtcataggaatagaccctctcttcctaagtgtaccttagtaaaatcttatatatatgttcaatcaaatatacaaaagtattccaataaattatattgtaagaaaccctacctggatacaactctactgttcatatacggtagaatggtggaataaataggaatatatttataagatggggatgaattagatacaactatgtgcatcaaaatagatgaatctgaaaatgatgagtgacaaacgcaaatcatataatagaaaacactcaatccacatagatttaaaagaaaccaagaaaaactaaatgatatattgtcttgggatatatgtatatatttagaactccgaataaaaatgaagagaatgattaagagtaaattcaggctgagcgcagtggctcacacctataatcccagcactttaggaggccaacacaggtgtatcacctgaggtcaagagttcaagaccagcctggccaacatagtgaaaccccatctcttctgaaaatacaaaaattagccgggtctcaaaaaaaaaaaaaaattagccgggcgtggtcatgggtgcctgtaatcccagctacttgggaggctgagacaggagaatcacttgaacctaggaggcggaggttgcattgagccaagatcacgctgttgccctccagtctgggtgacaagagtgaaactctgtcttaaaaaaaaaaaaagaaaagaaaaagaaaaaaaaggaaaatcaggatagtacctgtagtacctattttatttatttatttatttaacgatggagaaagaaaaaggagacaatagtgatgggcataaacagtgcttcaatagtatagtaatgttttatttcttagagcagatagtgggcacatgtgtatttaataattattctttgaactattcatacattattatgtatactttttaatatattgcaaaacactataaaagaaactttttaatacaatacaaaaacaatatgaacaataataaagtcctagaaatgcaatttgtaagaaataaaagaaaaacatttttaactgaggggcataaaaagaagcattaatacatgaagatttatacagtttactggataaaaggactcactttaaaagtgatactctctgcttcccaaaaaagagaaaaaaaatgcaactgcagtaaaaattgtgatgaaatatgtttgaaattttataaaactcttcctaaattcttctggaagaatacatgggtagtgatacctcaaaaagctttgcaaaagaagaataagacttgttctaccaagtatcaaaacatgtcattttaatgcgatagagaaatactgtcacagtaaaagctacaacttagtgaaatagaacagaaagccaaacaacatacactagaatataaaataatttaatatggtagtaagatggcatttgaaatcactggggcaagttttgactggtcaattaattgtcctttacaattgagaaaattgtaaggaattatagatttctaccatgtatggtatacacagtaatttcagaaatattaacgtgtaaggtgtaaaaagaaaaagatgggaataaaacagaaaataaataaattatagaacaactattcatctgtactttccattcatctgatctggtgtgagaaagagaattttccccagattggaaagaccaagatctattagcttgagtttcatgctcacagtcttcatcagacagacacttcttattgtccatcagacacaccctcctcaatttccgtcagatagaccctcaaatgaatgaatagaattttcatctctctattctgcttgccttctactctgtgattaaagcttctcctgtctttccaaattcttgatgtaattcgtcccccactacacttttggtagatggcttcaccccacttctcaagaaaacagagccattaggacacttcaattcctccgtacaaagcattagcacatttccatcctctcctcttctctcacaaaaggagagaacccttctttcaacccacccttgctcttgctttcaggaccctaccattgtaagttatctcctctttctttctcactcttcttcttacctctattctgaattttttttttttttgagatggagtctcagtctgtcactaggctggggtgcagtggcatggtctcggctcactgcaacctccacctcctgggttcaagcaattctcctgcctcagcctctcgagtagctggaactacaggtgcgcgccaccatacccagctaatttttgtatttttagtaaagacagggtttcaccatgttggccaggatggtctcaatctcttgatctcgtgatctgcccgccttggcctctcaaagtgctgggattataggcgtgggccaccaagcccagcctctattttgaatctttttcttagttgctttaatcataacctctcttgtctttaagagagtcattattttggctccatatctcattcttgttatggtttgaattcccctccttttcacagccagcattgtttacttgcctcacctcaccttcccctctcttctcaaccctcttcaggatggcttgtgatgccaacattctcccttaaattactcttgcttggctcacgagtcaccttgaggacagtaggttcaatgggcaagtttaaagccacatcttactcgactactcagccatatttgtgactgctgaccagtaccttcttgagcctctttccttctttggatgctacaatgacggcttaccttcctggttttctggttgcctctctgaacactgactcccagtttctccattcattttcctcctaattgttaattctggagttcttcttcacttagtcttagacctatttttttttctctgctctatactcttgccatctattccctgcctacggtttccatttccaaacattggccccagtcttcccatatccaactgctactcagcattgccacttggatgttctatgtatacctgaaataaagtatgacaaaaactgagctcaccagcttcctctccaaaattggtcatcctttaaggctccctctctataaacaacattttgatcccccagttgtgtaaaacaaaagggttgcagttctccatgacacatcccttccctccttcacccttatctatcaccaccaagtcattgatcttccatgttgccatcctctgagtccacatctgtacaatctatttcacttctacactaccatcattccagtccacgttacaattctttctcccgaggatgacaatgacagcctcctaactgatttttctccttccaccctcaacctcacaaagctgtccaccacactacagcacctcctccccattttgccctgataacttctacttatcaagcaactctaacttatgtgccatttaatatcctaacttgccattctaggttgttctctgcttttaataattctcctagtaccatatccctttatgtcagagtcctgattaaaaaaatgtaatgaattagttttgagtataatcgcttaatgtctgtctctctttccagaatacaagctttaccatggatttgactacatctctctttgttattggtatatctctagtgtccatcgctgtcccttcatcatattaaatacataataaatatttctggaaaggaagggtggataagggaaagcaataggatacctgactaattaaaagcttctgcatacctaagtgatttcaaaagccaacaaaaaaactggcgaaaatatatttgcaacctatgcaagaaagcttacgtccttaaaatgaaattacaatgacgagcccataagacaaagatgagcaaaaatgaagagccatacaggaaaatgagcacaaggtatagataatttgttcataaaagaagcaatgtgaatggctaattaggctgaaaacaaaatctgtactctccagtattctaaaaaagacacacatacacatgcacttaattttttaaatagtcagtgttggcaagaacagacatagtcttctgttggggagtccagaatggtacaaactttctgaaaggcaatctggtaatatatgtcaaaagccttaaaaataaaatagttcatttactttggcccagtaaattaatttccaaagcattaatcttaaggtctatctgcagagttgcatgcatacttacctataagcatgctcattccagcattgctcaaaatcatgaagaattcaaaccaactttaatgcccaataataaaggattagtgactataaaggggcaacgccccctctaagcagccattaaaatgcatggccccagagaaatgtatggccccagagaagcctgcaatttctttagtgataaaataaggtcacaatgaaatatgcacagtaggagttaacatttttttaaaaataaaaaatatatatatgcataggcatatctttttttaataaaattttatatgcataaaaagattggaaaataatatttgaacatgtgaattatgagtaattttgttcttttccttttttaacctttttatatattcttaatattcaacaaattctgtatagcatgtccataatgagcaaaactaaacatattttaatttaacaaaggggaactgattgcaacatatggccaaggctatatgtagagaggcgtagcgtgatgattaagagtatatgctttaaaactcacagacaggtgtttagttccctctttacaacttaagagccatatgaccttcagcaagttattccattttctcagcctcagttctcttatcgacgcaaaggagataatacctactgggcagaggtgttttatggcttaagtgaaataatgtaggtaaaattctagtccaagagtaagtgcttttataataccaaaatataaatagatttggcaacaatttactgaaattcattatttctaaggggttacagcagaaagtttggggaataatttgttttctggctcaccgtcttccagactgttgtaagaatagtgaaatccagcaggaggatgctggcaggaagactgaccggcttatagaaggagccccaggaaaggttgcacttattagttcaaaatgctggcgtaggtcattcattcacctattcatccaaccaacaaatagttattatgcatctacttcatgccaggcattgggactcaacaacaagtcaagctagctgccttcttggagcaaggcgagcttcttctaattggattggggtttcaagccacatagttcatgttggattcaggaattagtcaagaaactgatgaagcactcctaaagttagagaaaacttggcagagtgaagaaaatgatacttggtaagatgatgggaagctcactttgcatttctcaaatacaaatcctaaaacaagcttgtccaaccagcagcccctgggctgcatgcagcccaggatggctttgaatgtggcccaatacaaattcataaactttcttacaacgttatgagattttttttttgtaattttttttttttagctcatgaactatcgttcgtgttagtgtattttatgtgtggcctacaataataattcttcttccaatgtggcccagggaagccaaaagattagacacccctgaagcaaacacctcatttcagattcccacctctggcagaactggaaactgctcatgtcctttctgcccttatccggttcagttcataaaccgacttgctcagtctgcagatgaaaagcctgatcagccttctgaaaatgggttagcaaactatggcctgtgggtcaaatccagcccattgcctgttttcataaataaagttttattggaacgccaccgtactcattcatttatggattatctatagtcatttttgtgctaaaatgacagagttgagtagttgtaacagagaacgtacagcccatcagacctaaaatatttactatctggttctttacagcaactttgtcaacccctgttctaggtcagcggggctggagaaatgatgtggaaggtgacatcaagttcataacttttccattctgtagttccaggagctgttcctctagaatccatccaaggggggccctttgaggagaagatctacatccagtggaaacctcccaatgagaccaatggggtcatcacgctctacgaggtaaggaggtcccttgtgctgcatccattggcttagctttattcaagtcacttcagcctgacattggtgaatacccattctgctgaacgtataaaggtgagtaagatgagacataccaaaaggtttctgacagtacaatggggtgcaaacataatggcacacagtggagctgtcctggtagccccaagaacaaagaaatttgtacacatcatgcattgaagtgactatggtgacaactgacctcatccacaaaagagccaaaacccagggagtcagattgttcttatgtggaagagaaggcccaggcctggcaaacagtactgaaagttcgtctgggaaactgcaatacccacatgatgctcactttacgaatatcagtctctttgctttgaaaagaatcccaatgttattctctgcaccagggacacaggattcttcagatttaaattgctctgtgcccaaggcatattttgtcacccaggtgatggcatccaaagcccccattccaagcattagctgggccttaccatatcagagatgaaccagaacctactcaagcaggaatgtacccatcaagccaacacaatgtgccttccagaaaagttgcaaaaataagacaaactgtatgaaagtttattgcaaaacaaaacaaaaaaatctccaacagagctgatatagctaagattcaagtattgcaatacgagtaaggttgagtctcctcccaccccttgtattcttacacaacataagattacaatactagatcaagtggaaacacacaggaatgcagagggaagggcatggataccgaagctggaatgatgtagcctagtgtcctagtagctccaccttttcctgagttacctttggtagattcctcctctctttaagcctcatttttctcacctgtaaaataaaggtggtaatcacttcttcagggtttctctagggaatctgacgagggggaaagacacaagcatcccagactgaaacatgtaccacaggcccacgaagaggcttaagtcactgagagctcatgcagaaacatgcatgtatagggagtgggcttgggggaagaatattgctgccataaggaaaggtgagctctggggaggaaagtcaaggagtatttgatgaaggaaaagtactcaagattaatctaacagaccgataacctctctagagagtcacaggtggtcctgagaactctctgagggagaagattatccaacatgtacaaggtgcttaagaaaacaccttatctcactaaaactagcattcctcaggagagctaacatctccctcttagaagttgcagggagcttggcgcagctctcaggattaccagatggaaggaggaaacagacatccatccccatcacttatgagttttctcaggccacacgcttgggagaagctttcttcctggggagtaccccgagaggagggcaggtactcatactaatacaccttgcctagcacattttcaaaacttctttgggaaagagaggttcgaaaatttaactgaaacaaaatccagtcacttcaaatctacatgttctttgtaaagcagaaaccacaatctctctctctctctcacacacacacacacacacacacacacacacacacacacacatttacatgaaataaagatgtgttgtgcctggcaaacttttctttgtaaagcagaaggaaaggacccatgatttaggaagttaagttacttgatactgttatgtaaaagacgctgtgtgccagatgttcaagacttttggaattcacaggccagtagcatttaaaaaggcttgggggactaacctagggtacttcaacatcttttatttacatcgttttataaaagacataattccaaaaatatagaaaggatataatttcagaataaaagtccatccttcaaattgaataaatttatgattttttactaactcatgacagtcacattattttttctaattttgcactggattgatggcaactttgtcatggaaaagccctggtccttgtacatacctgcatttggaaactactactgtagggctatgttgcaggtggagtcatatctctgcacatattattccttgagagtaatatactttttcctctagtaggatgatgcattagattggatccttgagagtaatacactttttcctctagtagaatgatgcattagactggatgagaaatatcatgattaaaattccatgacaagaagaaagaaacagagggagagcaagggtctaaacacaactgtgagttagactctgtgtttgagtagaacctcctgcaattgaggcattattatatagtgcactctctgaagccccatgcacaaaggtgggtacagattagagcaggttgtccttctcacttctgtgtgaatctgatgccttgtggattttcagagaccagatgccagggatgttggcattcccatggattctatgggagacaactatgatgaaagacatcttcaggtagcttcttcgctgtgacttgggctataatttgcagagaaccggaaccagagtattgtaactggttgagttgtttgtaagcatttgaggctacttttgcggaatatgccaaaattattgagggatgctgtaaagacagctaaggaggttgtagatttaggccattgtattgtgagcataaacatgagtgtaatcttgtgtatcaaaagctagtgaggcctaagaaaataaggatggtgacatttgagcctatatagcctagatctgaatcccagctctgacatttacttgctctgtgaccttgagtacatcaagtggcctctcagaaccttaagtcttttatcagaaaaatcaaggtaataataaaatggccttataggattactctgaagatctgattaaattaggttttgtacagtgtttggcatttagaaataacattataaatgttagctgttatcattacataaaaatgaggaaattgagtgcagagggttaaaatgaaaagaccaagttcatattacccagatgccaaacccaggactcctaaatgcaggtacagatgtcttgcccctttctgcaacttagcgtggtccatagaccagcggcattagcatgacctgggagctagttagaaatgtagcagctcaggcctctccagtttaacaagatccttgggtgattcctatgggtattacggtttcagaagcactgttctggaaaatactactcttgagaaacttttggcaattgagagtatgttctcttgagtagagagatgagaagtaactgttactctgggctcaacccaatccagccccagacagtaagcaagagaccttgcttttaaaaacatttataacaaagcatgtgtttatgaggcaatttacaaatttaattagatgaaaccaatttgatttttaaaattaggttctagttgtaatttcaagagagaaattcataaattacaaattaccctcttttggcctcaaaatagaatattttattacaaagaaaaataggataatgcaaatggaagagaaattcaggattgtctgtggccttctatatacaaccttggcctcagcaaagttacaagcaaagaaaaaataagggaggggaaggagggaagtttcattactataactatgttattgttaaatacagcaggtccaagtggttcagattaaatttccttctgcacaagtccaagtcacagcctctgagtccatcctcagacaattctgccccccaaaatgtgagtggctttaagtcccattctgtctccagtcttcagtcctctgtttctaatatgaaggtgtcagactgttcttggcttcaactgggtaagaatgaaggggaaagtaaatctatgtcaaacccatgaaatcaaaaattctacctctttttggagttgtttaattcttgcctataagccagccaaagtctctgaaggtaaagtagtgaagatgaagacatatgaataaaaacagtgagtgcaaaggccctgaggtggaaatgacttaggcaagtcttaaaaatgtagtaaaaaggagaccggagtgactggggcctcctgagcacagaggacagtgatgagactgtgtgggggaaagggtgggtagggccagggatggcaggactcctagaacttgcattttatcctgaaaggaatggaaagccctaggagggttctacacagaggaatgaagggatccaatttatattcttaaaaggtcatccagctgttgtgtggataagagatggtgggcacacaagcatcctggaaacatctggaaaatgcaccaggaggcaaggacatttccatcatctatgatattaagatgaactatttattaaaagaccttatacctgagcagaagatgtgaaagtgttgttacagctgcctctttactgctgctagcccagctttgacaccctctttttagtaatgagttattatcttgatgagcaccctggagccatggacctttagatcctgggcccaccttccctgaaagatgggtgtctcaccctgaccctattaccactccagggctatgaaaccgtctcattctgcagcagcctcaaactctctctctgcccactgaaaggggagctcagaatcctcgtcagagcccactggttccggcctcatctgagctgcaacaggaagtattaagatgaattagaccatggcctcagatctttggggatttgcactttagtgggagatgcagaatgcaattctatgatcattcccctaacagagtgacagatcatgcacagatagaggcagcaccaacggccttgtgtccacaaactagcatcattaacatcacttgcaggcatgttagagatgcagaatcgcaggccccagcctggacccactgaatcacagtcttcttaacaagatccccagataattcatgtgtacattaaagcataaaaagcactggtttaagaaacattctcaaatctcacaattgtgatcagcacaagagggtggtagaggtggtaagggaatatcaactggtctggaaagctctgcctgatgaaaacattgcagtcattgcatgaataacgtgatcatttaatgcagtaaggaatattcctgctcacctgacgtctaaacaatatttacatcaggaatatggaaatcatgacatctgcatagactcttccagaaccctgcttttgggtttgattaaggcatcagggttccctaatcagggtgtggatgtgcagaagggtggtgtggcctctctcattctgactcagctcttgggaacaaccacaactcaccaagaacacagaccgtcgcaattgcggacaggcacttatagccagaatgaggtcaccaagggaagcaatccaaccaaacagttgtctaaaaacccttcaataaaatcattcagagacaagctgttcagagttcatggaaaacagtaatcaatatgtgtttcaattcaattaattgttctcgtcttcgtccaaaaataaaaatcacacagtgtgagggaattgggccagaagatgttacacttgcaactgggttaacgaagtgtgaaaatatttaaaattcagacatatgaagcctcccagtaagcctttctgtttagcagtcaaaatcaccaagtttctaattacagtgtataaatctgagaagcttaaagggaatgagaagaccctaatgaggcaggaatgggtgtcttgattatgctagagttgattggcatttatctcacaagctattctaggtgcctggcattcagagttaaataaaacagacttcgcttcaataaaacaaggcggcattcctgtatgggagcgcctttaaaaggtacaataggtcagagggtttgtcaatatttttttcagcacacagatggttggattcaatctgaacaaaaagcacgggccccaggaatcaacaagccatcagagtgcattacaaggaggctggagcgtcttccgagacaggagttctgaacagaacgaaagcctgaacacagacattgatggagagaggggaccagctgggtggataagctcacgaggaaactctttaagacagaggcccagagaaggttcctggctctgtctggatggatgagcatgcctcctcccatccctcagctttgctgcactgaccactcagggctcactgaccccagactggctcatgactctggtccacagaggagcagtgtggagaatgggatgtgttccagatgggcaggaggtagtctaggcaggaggaaatcagctggattgtgactaatacagcccaaagcaaaaatttgcataattcaaactggatctacgttaattaggacacatgatttgcataatgcaggccgctattgagtataactcgagccaggctggtaacaaggaaaaaagctcttgtttcctctaaattgttcaagccagaaatgagagcgtcatccgttgcccccagcagccacacagctaatccgccagaaagtttgattatttctcttgccaaaatagacacaggtcaggccgcatggcaccatctctgctgccacatcctgttctgagcacccctcagatgcttggagcatttcagttcctccctgcccacccccttccacacttcacctgttccatatgtccacactgcagccagacagaacatcttaagaggtaaatctgatcctgttcctcgtctgctttggcttcatcttaacttcgaggcactgaaggatctggcactggctgcctctctatcttcacctgccgctcctcttcccattgcttactgcagtccagctttagcctcctggcatttcccaagctcacccagttcctggcagccctcgccactctgtgtcattccttctgcctgtaatgctcttcactctacactcgtcagggctggctccttcctcttcttcacctccaagaggctttttccctccactgtccacttgatctaaaacaggttcccctctgtttcctctcttaacaacttgctttccttcataccatttccacaatctgcacttgtttcatttgtgtacttttgtatcacccaggcccgcaacagacttgaaccctcgtgagggtatgggtcctgtattggtgaattttatgtgtcaacttggctggaccacggtttgacagattggtggtcaaaccatagtttggatgattttgtgaaggtgtttttggatgagattgacatttacatgggcggacttcgagtaaagcagattgctccccataacataggggagcttcatcccatatgatgggcttcatcccatcagctgaaggtctgaatagatcagaagactgagctctcctgagtaagagggaattccccagccgatgcctttcagactggaactgcaacatcagctttccccggttctctagcctgacagcatttggtcttgacataactaatacaggccgggcatggtggctcacgcctgtaatcccagcactttgggaggccaaggcgggcggatcatgaggtcaggagatcgagaccatcctggctaacacggtgaaaccccgtctctactaaaagtacaaaaaattagctgggtgtggtggcgggcacctgtagtcccagctactcgggaggctgaggcaggagaatggcgtgaacctgggaggcggatcttgcagtgagccaagattgtgccacttcactccagcctgggcaacagagcgagactctgtctaaaaaaaaaaaaaaagaaagaaacaactaatatatgctatatttatttttgcctttcagtgtgtcctgaggacctaaaatagtagctttcacatagtatgtactcaataaatattctttggataaatgtatggatttgtgctctatcctagcaaggggcaatgatgattatttttgtctaactaatttagctgttctcaagcttggctgaagattagaatcacaccttgagataccttctgctcaattttgctgtgaagctaaaactgatctgaaaaaataaagtctagtttggcctggtgtggtggctcacacctgtaatcccagcactgtgggaggccgaggtgggtgaatcatgaggtcaagagattgagaccgtcctggccaacatggtgaagccccgtctctactaaaaatacaaaaattagctgcttgtggtggcgcatgcctgtagtcccagctacttgggaggctgaggcaggagaatcgcttgaactcaggagtcagaggttgcagtgagttgagatcatgccactgcactccagcctggcaacagagcgagactgtctcaaaaacaaaacaaaaataaacaaaaaatcctaccttgagagcttgaaacaatgtatagataaataaataggcgtctagttacctgaatgaatgcagggatggatggatgggccttattgcggtccaaataaatcagaatctctaggggagggggcgctatccatatgctgtatttgtttgttgtttttaagttccttgagaatttcttaaaaacatccagggttgggaagaagcattgcatgaattgaatccagtcggtctcctctgatatgtaatcctagctaaacaccttctaaataaacccagtcttgatcctggcttaacctatcttcactctcactctgccagactccacctctatctgatgttacgctacagccaactcactcatacacaggcagttgctaagtgttaatttttttaaggattaaattcaagaaacattggtcttttttccctcaaggttgctaaacagtgtgtggagtaattgaagaaacatagggaggtatcgttctgtcaatatccctttgcatgttactaatggcatcttgcaactctgatgccagagcccaccacagaccttcccttgcaaatctttttccctctcctgaatagtggaagtcagtcctgttgtggttttttttgtgagattaaaaaagacatgtgcacacacaaaacaatagatttgcccagaggccttccctaaatcttaaaagtcagggccctgggatgtctaggagccatttgttctagtccacagctcatcattcaacctccataagatgtttcccctccagaaacttgaaaaatgcaggcatccctggttagatgccatatacaggtcattcgggctgacagggaagctgacaggtgtttcagtagcaacagctctggttgaaaagaatgatttctggcactcagagtctggaaggaaaagaagttgcattctgatgtgagtgacttgcatttatgtacctggtcgcattagagctgctggtcatccacttgtggtatattaggattgcctctgtatttgccttggggtgtttcttcttttctattacgacacaggtatttgtgatggagccaggtaacttgacagtggaaatcaacagatgtgtagcacttgttacctaaggatagcaaaccatgttgtcctgccagtgaggttttcacagtaaacattaatcattcagttcagctgtggaaaacaataaaggttgctgcatgaaaaatattcctgcactgcgcacatgtgaataagtatgcttgtcttggggtgtgtgtatgagcatatgtttttgtgagtttatgtagttctacactgtcacatgtatacactcatataattgtatgtttggtggcatgtctgtgtgaagctttcatcctttgatgtatccatttttccagcttcatccttaggattgttctatttcattggagagttaactgacagagatatcagagacacagggctatgtctgttttctcctggactaggggggcctgtgatcacctcatatccgtgccatggtaacaccaggggagaaactttctttcatttcagtgggctcccagctgtttaacatgaacgtctgccataatttgtctccagagttttgctaaagaaaaatgttggattaaaacaaaagtctcccggttaaattgaatcctatgcatctacagttgtcctaggagagagaagggaaggaaatgaagagtgagttctgcatttgtcagggcgtgggctttcttcatgtttcttatctgggagggaaactgcattttgctgcactgcgtgtgcacccagaggcctttgtagggtgtccttctgtgcacatggccacatggctagagatggaactttctccctggctgctgtggtcctttcaataaactgtgcccagaggcagcacttaagttgtgaagtgtctctttaaacatcacaagttgttctcttttcatctcagatgttttaccgtgttacccctgttggaattccgcctaggctgggcaatgcagcatgaatttgctgcttttaactggctctttcgcttctgttttggtcagaacaaaatgaaaaatgtttgcatattttcatctatcatcaggacatttggagcctctgttctgaagtctctggaggctggaattccaatctgtgatttgttgcttgtcttttcattagctcgggagctagcaggtggtttttctcccctcaccttaagtcaatgggcattttttcttttgactgctttttcttactctttaccaagagaaaagtaattccttaaaactgacacccaagtatgagatcttggtctacctcattatggtttcaatacatacatacatacgtacatacatacatacataccatgtctccagggtccttcaagatggcctaaagaaagttcactgctttcttgttctgttttattttatgcacgtttttaacgtgtgtatcgctgcacgtcaaatagtgggttgtgcaaacagtaaatttaagattgacctttggttagtcattgcagagtgtacttgaactagttggcttctttcccaacctgggcctcagtttccacatttgtggcttaggaggcttggaccagggagattcaaaaagctctttctgctatgaactatcacttgggtgcccaaaatgagattaatctcactcctagtttcatgaaactgtttctgtattggtctgtgcatgggtctcttttctttttatttactcattaatttttcagtaacacaccaactaaaagacaaccagaatgctgacaacacctaacatttacttatgatctacataagcacatctgtttctactcacttacgtctccccatcccatcttcctgacccctccactcttctaaatcttgtatataattcctgtatattttatatagttttgctacttgtgtgaattccttataagcatattgttttttagtgttttaacttttaataaaggattttaagttgtgtataagcttttgggacatttttattccatattgtattgcaaatgttcatccccatggatgagtgcagctgtagtccattcatcttgactgctgtctactactccactgcacgaagatactacaaaactttcactcatgatcctttcataaacattggggttgctttcagaatgttgcctttatcagcagtgatgaaatgagcatccttgtgcctaccttctcctgtatatgtgcaagattttctcttgaatttctatctagaaactaggtcagatggtaaatgaatgttaagttttacaaaaatactccaaactctttcccaaactggttgcactaatttacactcatgccagcaaattatgagtgcctatgatttcaaaccctctccaacatttggtgttgtcaagattcttcattttgactaaataaatataaaatggtatcttgttgtcttgctttgtattccctctattattaatgaggtagaatattgtatttcattttctgtgggatatctgttcatgtcttttgcctacttttctactgggttatatgctcttttctttattgatatgtaatagttttataatatacttttgataatattttgccagttacaaatgtaatttgctgtttttacttcttctaaggtatctttgaaaaacaaaagtccttaattatagccaattttatcactttgtttatatagttaacacattttgtgtccttaagaaattcttccctaaaccaaggtgagaaagatgattgcctatatttctgctaaaagttgcatagttttgctcctgaaatttaagtttttgatctatctgcaattaatttttgcatagggtgagagatggagtgaaaattttatttttttattacattgataaacactttatccaagtcctttttacagtctctccttccctgctctaccaggccatatctgacttatgccaaaatttcttatatgcatgaatttttttctgagctctctattccactggcctccatgcactgtaaccatgcatagtcatatttattacagcttcacagtgtcctgatctctggtagagaagattcctcctcctcatacttgttcagcaatatcttggttattcttgcccttggctctttcattttagtatctacttatcaagtttaatgaaaacatctgttgtttttattagaattgccttgaatgtatagaacaatatgtgggtaattgacattttatgatattcaatctctgtatatttatttaggttttctttaatatctctcatagttttattaccttacttttagagctattgcatttcacataaaatccaaactgctaccttaggtctgaaagacttgcacctcccattctctttttccctctggtctcactggccttcttttactgtgctccagcatgctaggggcccctgtctcaggcttattgcacgcagagttcctattgccagaaagctctttcacttcctcttccatggccaactcattctcctactacaggtattgatgtgaatgctaccacctcagaagggccctgcctaatagccttcaggtagggctttgcccactcaccactgtctctaccattgcttcccatttttggataacatggaccacagttcacaattattttttatttctttataaatgtctagccttatattgtaagtgccaagggatacacacatttataaacaaagggactcacaatatagggatacacatgtacaagcaagtatgtgcatataaatacacacacacacactcctatatatatacatagctcatctctggaaagaactcagtaccttacctagtacctggaacacaatagggtctcaaatttggtggtgctttttttcttttctttttgttttcttttctttttaaaattttctcttttttttgttgtttttgttttttgttttttgttttttcctttgagatggattctcactctgtcacccaggctagagtgcagtgatgcaatctcaacttactgcaacctccacatcctaggttcaagagattcttatgcctcagcctcctgagtagctggaattacatgcacatgccaccatgcttggctattttttttttaatttttaatagagacggggtttcaccttgttggccaggctgatctcggactcctgacctcaagtgatccacatgcctcagcctcccaaagtgctgggattacaggcatgagccgcggtgcctggcctctttttttttttttttttcttatgaagatgggatgggcttttcttatgaagatgagatccctttgaaggcgtaggtagagtaacagaagtatctcttagcatccattagtccatatatatgaccttataggaccatccaaaatcataagattatgtcccaagtcttataataatctctaatagactatatgaggttccagtgaccagtgagtttatacttaactcatagaattaatttgctaaagtataaacttgttaaggttaaagatctgtattcacaggtatatccccggtgcctagaacagatcctggcacaaaatagggttcaataaatatttgtttaataaataaaaatgcattccaaacttgagtcaaggttaaggcaacaggcgtaagagatattcaaatatcgacatcgctatgatggcttgattttttaaataatttagttttcattaaatgttagtgacaatataacaatagtatatagtgttagaaaaatagggagtggaaataacacactagccatcttcatgtgggtttattttctttctagttcttgtgcatttgcaacagctttgacgtggttatggtgactttttttttttaattttcactatgcccaacatattctcatttctgtgtaatctatttattccatttaatggctctccattccctgaacatatggaccatatttactttcaaatcactttattcgggatgtgttgattgatcttactagaatgttagatataattttgggggtatgataagagtgaactggatctttttaagcagctggttaggagagtttgaatttctgctttccttttccctctcaatagatttttcagtagcaggcagtggcattcacatgcgttccattgattgtagaactgtggtctaaataatagctcactatgttcagtagacatggatctaatggaggagagtcaaacaatacatacacatttggatgggatccataaactcgaggttagaagtggtggtcctgttttcctccttgttttaaaacttgaatttcagtttgcttatttcctagcagagggagatgaatatagggcaagtgtgtgccctgactcctccctaataccattcccatgatggacatcaataatcaatcagggcatgctcttccactgcactccaacatggcctcagaatccctttcatcatggcacagcactgcagctggtcatttccaacagaatggggttagcctgcaaggtataccctgcctgctgtctctggcctcttctcagaaggttgatagggggataggtgaagctctgccctcactcattggttcatcctacagaatctgtctttatggtaattaggtaatttctggatttctttttttttctgcagtataagcatgttgcagtttccaatccttttcacaacagttgtaatcctagtggactgtgttgcagtatctgcagggacgtcagcattatgggccaacaagaagataaagcagatggtgtgaggttctggggaaacttcccacacactgtatcccccatcggcagctgggtttccatttgccagtagattaaagcaaagtccagacatgtccgtgtcagagtcccacccatctcatgactgaactcaacatggtgagtcaaaagtgttaacagaaaagccaaactttgcaaaatcttttaaaaaggtttattctgagccagtatgagtgatcatggcctgggaaaacagtctcaagagatcctgagaaagtgtgcccaagatagtcggattatagttttagggtggcaagatttacaggcaaagacataaatcagtgcatggaaggtatatattagtttggccccaaatgacgagatatcctgaagtgagggcttatatgttataggtggattcagagatttttaaatttgtaattggttaaaggagtaaggctctgtctaaaacttggaatcagcagaaaggaatgttttcagttaagataaagatgctatgtagctggattgatggcctgcagctgtgacttaacccttgctttgcatgactttaggccttgttcataatttggttttgtattgccacaaagagtctgttttaaaattaatgctggtcaattgtgcctaaaatccaaaagggagggaatgtagtaacgtgtgatttcctttcccccatggccaagaattccggttttcaggtttctctggggtccccttggccaagaaggcatccgttcagttggttgggagcttaggattttacgtttagtttacaaaagtaccaaagatattggaagtgaaaacaagcagtggtctcaggtctctgaggatcagcctagtgacagcaagaccctagcctgtgtgtggaggtgcagagaatgtgtcaagactcttgcaagcaggtttgattcagcagcctcccaggaagggctatgttaggcacactggtgccataggctcctgggtatcaagtcctaagtgaggcttagactgcgattatctaggaagacatggggaaggtgggaactgaggatggcttgggcgtctcccttctctcatagctgttttgtctcttaacaagatagagttagttctactctctcctcatcctatgagccatgcccctgaagactagcccttcactcccagcagcagccatgctgtcagttgcaatgcctaaaggccctgtgtgtccgttcccacctactgtataaatgttctatctgctgttgtgagaggcagttctttttgatgatgcttacctgtgttaccacttggataaagagaccagagctatagaagccttcctgaaaatgatgccagaggtgagagagtctatgttagagcaagtcatctagagagtcttcatgactgaagggcagaaccacaggaagataaggccaggtgcagaggtctcaagattttgtaggaaatcccgttaaggatcttgtatgtacaataggctctctgctctccccaccaacaaatgcattctgttatcttagcctttcttggccaatttttataacaatattatagaatgtttggatatcagagaaaaagatcacctataatctcttctaccacagtgctaattttgccttgtattttatctttgttaatatgcacacatcttttacctaactataattacataaaatttgctattgtaatttttcattaactgtttaatcacaatcatgatgcctttatagaaccatggaaatagttcatcttttttaatgatggcataattgtccattagtgtatataccgtaattttcttatccatccctttattttttatatatttgataacactatgataaacttcatgtttatggtggcattgcatcatggtggaaagaacatgaccttcagatctggttgacctggattcaaatcctagatctaacgttgcctaggtggctgacttttgggcaaattaacctctgaaattgaatgatcttattggtttaataaaattgtgtgtaggagaagcaatattaagcctacaattcaggaatattataagaattcaaaatgtattgtagtcctagctgtccagtatccattcaatgtcaaagttcgttttcttcctcctctgtttagagtatttgtgtattagacactcccacccccaccgcacacacgaacatgaaattactgggttgaatggaatgaatacttttgtaactcttgctacatattgccaaattgcactgcacatagatctcacctgtgtgagtgtgtgttttaagtattgtgttgagtttttatgccagtcatcatgtctgggaagaaggcctttggcagcccaccagagatttatgtcagctttcatgatactctcagagcaggctgatgtgtgaaaagcgtatcatgcatgttggcagatccatttgcactctccaaggacgtgctggagacactcttgcctcatcaattcctgttcactccctttcccctttgcccttcaatagcaagtagattgcctggtccccagtcatctcccagagggtcctggaagccccatgggaactctgaattgaaggactcgcagccaggtttctacagttcctgccaccaactttatgatacatcaccagccatgcccttccacagcctctgttagcctacctgcagaagaagaggttgaagcagttgggcctctcaagctgaacctctctgtgttcttctgttatcagcatcccctgggagctttttaggaaagtgctatctctgtccccaccccaggtcttctgagtcagggtctgcactgttacaagatccccaggttgtcactgtgcacgttgaagttcagcacgtacagtactgagttgtctgcaggccaagcattttccatcatgccaggaacatttactggagcctcagttttggaaccagtctttccctgaaccatgctcttgctacgtcaggatttcctcaccctgctgtgaaattcctccccttgcccagttatatctgtggaccgtggaccctggaccgtggaccgtggggaccttgctcatgggttagaatcagagaaaccaacacttccctccctgaagagaccaaaatcattttgctaaaatacagattatacagacactgtaccatttaaaatccttataaatcccaacagctctgaggataaaacctaacctcctctttaacttggccaacagtttcctccatgagtgactcagcccttgcgggcttgcccagttccctctcctgcttttccatccccactcccaaatgcacagactttacattacagccacactacactccccttgctatcttttccctcttcctcctttcttgcatcctcagcaccctgctcaagggttctttggggcatattttgaccctcggcacctggatgagggcttcctacttgttagtttataatagaatttattcccccatactgtgattgtggatttctacatctgtctacaacttggctcagaattcttagacttcctggcataggataggtcatccatgaatggcagtggtgctgctacctgcccttccttccttcatgtcttccctccacctttctctgcctgtgccctggcacaggagattgagtctcagacatcactgtgttaccttgccttctgttcatctgaaagagcgccttgcaggggatgaggagagagggaggagaccaagggaggggtgttgactgctgcagctttctcccctccagaaaggtcacagctcctcccaaggtgacctttcaggttctaggacctgctccctcctccacccctcccactctcgcttacttagttcactcctccacgatacctctgccccgattctctcaaccggctcacagggttgtaaatagtgcctttagtcaactctccttgaattatctgtctatttcctgctcgaatcccatggagaccccattatctttaccatgtatcactgagagtgcttatcatcatgcattttgtctcagcccttcaaggtaaggatcactatccccatttaatactgagccttagaagaaggaagttacttgcctgagatgacctgactactaaacaaaacctagattcctactaagtgtgaatacaaagcttgcccacttaactagttagccacagtgccttttccaaaggcactcaataaatgatggtgaaattaacctgaatttcccaatcatgatcaatccacttgattagggtggccataagcttgcagatgtagggtggggaggagtaaaggcgcagttttggaatgaagagggtgactgaggtctggatctagccttggcttggaatccatgtagtctacatggtgtcccccaagcttgaattgccaaatccttgaggaggggtgccctgtcagtattggatgaacaaggcttgtgtagggaaatgagtgggaaaaaacaaatgggatgagttgagtttcatgcccaccatggaggtgacttcatcgtcatgattgtatttgcaaattccattcaacctgaacattcctgcaactgagtagacatattcagagcccatgcttcccctcctgtgaagctgagtggcatgcttgacctgatggctttgggagggctctgacacaaataggcactgtctggtgtgtcaacatcaaaggaaaattgcaaaaggcaaattgggctaatatttttcattactggaaaaaagtttcccataccaagtcaattttgaaaaaagaatttcgtctcttacatctgcacagaaatgtcaaaatggacagggctgtctgtaaacaagaaccatggcagttcatgaagtttctcactttcaaattaataattatttaaaaagaaaaatgaaaagaaacctaacctgggccaccaggatgactgcttctataacctcaatgttgatgggtgaacccagtgactgtaagtggtagtatggtcaaggtagcatttctccaactgtaatctatggaaccctttggcatgaggtgtccacacatttatgcctgggggtggccatagtctgaatgttggtgtttccccaaaattcttatgataaaacctaattcccaatgtagtggttttcatgtgcgtccgtgtgaggagaccaccaaacaggctttgtgtgagcaacatggctgtttatttcacctgggtgcaggcgggctgagtcccaaaagagagtcagagaagggagataggggtggggccattttataggatttgggaaggtaatggaaaattacagtcaaagggggttgttctctcgtgggcaggagtggatctcacaaagtacattctcaaggctggggagaattacaaagaaccttcttaagggtgggggagattataaagtacattgatcagttagggtggggcaggaacaaatcacaatggtggaatgtcatcagttaaggctgtttttacttcttttgtggatcttcagttacttcaggccatctggatgtatacgtgcaagtcacaggggatgcgatggcctggcctgggctcagaggcctgacagtggtattaagaggtgggacctttgggagatgataaaatgcttggatgtttgggaggagtctgcccttattaatgggattagtgctcttatgaaagatgctggagggagcttgttcaccccttctgccacgttaagacacagctagaaggcgccatcgatgaagaacaaaacctcactagacactgaatctgcaggcaccttgatcgtggatttcccaacctcaattgtgagcaataaattgctgttgtttataagttacccagtctgtggtaatttgttatagcagcccaaactaagacagattttataagttttacaggtttgcaggctaacaagtttttaagtttgagaaacacttaaaaggatgaaagaccttccctttttgtgtattctttaactcccatggtacttcttaacctcagtaaagtattgccatgcagtaggtgccaaatagactgttacagaaagaaaagaatgggggagaagaggagggatggattttactttctaaatcaatggctttcaaatctgactgagctttcaaagctctggaggcttaaaagacaggcagatccaaattcttctaaaagctactgaatcagaaacttcaggggtggggccaggaaatatttataaatggagcccagaggagtctcttgtgccaccatgtttgacagctactgtggcaaatctgtctgcactgacctctgccctcctacctttgccctggttgggatctcaaattctcaggactcctgcatccatcacctgctggcttcccctggtcctttctccaagatccaccctccacatcagccatctgaccaacctgctgaaacaagagggttccctgaccccccttgcaggacacacaacaggggtgtgactcatccgttcagccactgtgcacattcaaaccccttacgggagggggagctcacagacaggcaggtgcaggagctcgggctagcacttttgggctctggccccacagcagcatccaggggtgggtgtctgcaactcccaaaacctcagtgggcatgctacagtgctcttttagctctgccatctgcagacggcttaagtgttaaccaattcagtgtcctcttagtacctgggttcttgtccagtgtccaggaagaatcagttcacacatggacttgaaggatggtaaatgtgggggtcttattgtatggtggaggtggctctcagcaggttggatggggaggtggaaaggggatggagtgggaagatgaccttcccctggattttggtcatccagcagccggtttcctctctgaacatccccagctgaactcctcttgatgtttggatgctccttctcttctctcctctgccatgccattctgttactcttcttctcttctgtttgtctgcttgtggagcccggggtttgggttttatatgggtacaggataggggagtgtggtgagccaaaaggccacatttgggcatgaaaagaggaatgcctgttcccatttagggctgtgggtttccaggcttgagggtgggggttttgccagggaaccctcttctacccagtatttccctgactcctatccgtatcactgtgaaacacacagacaactttcacgaaccatacagctctttaatccagcatttgggtacccctggactcctcatgacctctttagcttgctttctgatcatctgctttttccacctctatgttctggcagcaccaaactgcttattggcagccccttccagaagctgctctttacctttgtacttctttgcacattgataacgctgatttgccttcaaggcctccctctctcatccactggctgtttgctgggataatgtctgcttgcctcaatcatctcagtcattacctctcttttaccccagctttattgaagtgtacttgacaaataaaaattgtatctgtttagggtgtgcaacatatgtatacgttgtgaagtgattaccacaatcaatctaattaacatatccatctcctcacatagttatgatgttgttcatggtgagaggacttaaaataagctctcttagcaaatttcaagtatagaatacaatattatcaactatggtcaccatgctgtagattagatccccagaacttattcatcttgcataactgaacctttgcatccattgaccaagatctccccattttcttcaccccctagtttggaggacattatgatgagtgaaataagccaggtatggaaagacaaatattgcatgatttcacttacatttggaacttaaaaattcaaacttataagtcaccgagtagaatgggcattacctcttttcaaagagacttcatctcacctcctctaactggtttatgcacccccctcatgtaacattctggagtatttttgtcattgcaatgactgcattgcgttatagtaatctttgtgtgggtttgcttgtgtgcatctcacgctccaggcaaggattttgtcttgttcatcaatgtttcccagacatctagaagagtacctagcagagagtggatgcatactggatgtttgggtaatacagaacccatattactcataatacgtaactcacaaagaaagaattggcctttcttccccctcaacctgtcctattttagctgagcagtaaattccgtaatgtcaaagaaatatagaaaacaaaaagcatttcttgttttctttttccacacacttttgtcagccgtgtctatttgcttaaatccatctttttccacgcatacgtcagagagaggcaactctctttaacaggattcttactggaaccatctccctacataataccttaaaggcatcctagattccctcttgcgttcttgtcttgggaagaaagatgttgctaaggactgttttatatttgtgttctcatctgacaaaaagatgtgccatggctgctatggcaaagtctgtttcacagtgcccaggagcactgcaatttgctgtaatttcactgcacttggtgtggtctgggggctgctgcatccatcctcatagacagtgacttccaattacaccagctaattgtaccaaacttgagctgcttgtgtaaatgagtaaatcattcccaaattaggcacagggaagctcattttgcttgctgtttaaggcttttgaggcacagcgagccccctcagacaagtatccctcagtttgagagtgggaggcaggtggaaggtgtttactaccagctctggtgttctctgcccaaggctctggaatccactggtaggaaacttacagcccgacccatatgggtcctaggataacaatgcccttggagtaaccttgaaagctgcaatctgggctttaagtttctgtcagtaaattgggagtattttttgcacagagaaagtgcacctgtgacattggatttcagctggagacaaaaaggttttgttttttgaggtttggaaaacttgagtgtccaaagtcatgacaagaacaaaaatgttttaagggccaaaaaataaaaaataaaaaacctaaatgctttaaggttggtcccatcagcatctcaagagcatttggttcttttagcagatgccaaataaatagagatttactgggggctaagtcacagtttagcacaagctttaaatttgttttaaaaagttagttgtttatatttataaaatatagtaacagaaaacaaattatcagttactcagaatcttacttttgtttcatttttttctcctagtacctgtctatatacatatgaaatttttctgtaattattgcatctttattattttaaatgctttttcctcatgtaaaatgatacatagttacattgttagcattttaatggccacattctgtcccatcaagtgacactatcatgatttatttaactaccttatgtgacattcacatagcctctaacatttatccattatggaaaatcatagaggtttccatgaacatttttatgaacttgctttttcctgtcttgttaaattatttccttcaaataagtttccagaattatgattgtgatgtcaacagcacaaccccctgatgtttttctgggtttatgcttcccctagagtggtgcattgcatcaacccaagctctgatcaaaggggctggaaataaagaggcttcagctggaagaaggctgaggccagtgaggggcctgggcacaggatgaggccacaggctgagagagttggggccagactgagggtgtattagaagggttgtgggcaaagaatcacataaaaaagggaaatgcagtctaactgtgccactaaccctgggtgacgtgtcattccctggggcctgatacctagcctataagcagggagactaacaaggactctgtgaagtttgccacatggtggaaagggatactatgcaaaagtccctggcagagaaattgactcatttctgattcttttattagtctttctcttcctttttttttttttttttttttttttacttttaaggtcaggggtacaagtgaaggttttcatgggagctaattgtgtagattatttcatcccccaggtattcagcctagtacccattaattatttttcctgatcctctccctcctcccaccttccaccctctgaaaggccccagtgtgtgttgtgtccctctatgtgtccctgtgttttcatcgtttagctcccacttataagtgagaacatgtggtatttggttttctgtttctgtgttagcttgctaaggataatggcctccaccgccatctgtgttcctacaaagaacatgatctcattcctttttatggctgcattgtattccatggtgtatatgtatcacattttctttatccagcctatcattgatgggcatttaggttgattctgttggctattgtgaatagtgctacaatgaacatctacatgcgtgtgtctttataatagaatgttttatattgctttgggtatatacccagtaatgggattgctgggtcgaatggtatttctgtctttaggtctttgaagaatcaccacactgccttccacaatggctgaattaacttacactgccaccagcagtatataagtgttcctttttctccacatccttgctagcatctgtttattttttgactttttagtagtaaccattctgactggtgtcagatggtatctcatggtggttttgatttgcatttctctaacgatcagtgatgttgagcatgttttcatgtttgtttgccgcctgttgtcttcttttgaaaagtgtctgctcatattttttgcccacttttgtatgggttttttttctcttgtaaatttgcttcagtttcttatagatgctggatattagacctttgtcagatgcatagtttgaaaaagttttctcccattctgtaggttgtctttttagtctgttgatagtttattttgcagtgtagaagctctttagtttaattaaattccatttgtcaagttttgcttttgttgcaattgcttttggcatcttcataatgaaattttggcccatgcctatgtcctgaatggtattggttaggtcgtcatccagattttttatagttttggattttacatttaagtctgtaatccatcttgagttgatttttgtatatggtgtaaggaaaaggtttagtttcagtcttctgcatatggctagtcagttatcccagcaccatttattgaatagggaatccttttcacattgcttggtttttgtcaggtttgttgaagatcatgtagttgtaggtgtgtggtcttatatctgggttctctattctgttccattggtctctgtgtctgtttttgtaccagtaccatgctgttttggttactatagccctgtggtatagtttgaagttggatagtgcaatgcctccagctttgttctttttgctggattgtgttggctattcagggtttttagtggttccatataaattttaaaatattcttctctagtttcttgaggaatgtcaatggccttttaatagggatagcattgaacctataaattgctttgggtagtatggcaattttaatgatattgactcgtcttatccatgagcactgtctgctctcctcccccaaacacacacacacaccccgtcagcccatcaccctcatgtgctacctccacatgtccctgaaatcccacaactctgtcttcactcctaccaccttagtcgtgactgtcaacgtctcctggtttcttgtcctgactgtgataatctcctgcctgttgtccctttctccacacttttcccaaataaggtcacattcacagattccagatagatgtatcttttggagaccgccacccaacctgctgcacttggcaactcctttaaaaaagtgtgtgtgtgtgtgtgcatgcgtgtgtgtgtgtgcgtgcgtgcgtgtgtgtgtatgttagggggtcaggaacttgctggaaacaccacatgtcattacgttgagaagagaagtgcagactgcatctaatttttcagaaagatgggaggtaatcagactttactttttgagggtttatatgggatctacctgattccaaggagaattaaaagataaagaagaagcagttctggatcaaccaagaacagacacctgggctaatatgattcacctctgggtgagctatgcatgacttagggcaaggttggagcttttaaactcaaaagaggcagtggtgaaatcccctgtcaccaatcctaatcctttcctaaggttcagaagtgcactctgggttgcttcaactactgacaggggcttcttccatagctgcctcacttatccgcagcaattcccaaaccccactacagtgttctctgcaacacccccaaatgttgtgaggtcttggcgggggttggtcctagacccatgttggtaggggttggtttcagaattgcttaactactaacaatttattgggctcttcacactctggggacagacgaagacagaccagaatccccctcaaaaggtgggggctgtgaggactacatcagtggctcagacatcagtaaccaagtgagtatgtgctggacagcaaggtgagttgaatcccttgtgagaccagcgtaatgaggaaagaggaagagaacataacacaacatcaacagtgattagcctggcgtaaggagaagggaggcaaattattttccctttatgatttgtttgttttttctctctctctctccgggttttctaacaagcatgcattttgtttgcaatcagagcaaagaagcatttgtgtggggttgaggaagtggtgcacggccagaataagcaccggagctcagacatttatctgagtcaaaacgagttcagcattcctttttcatgataaccccaaactcagagattataggcattggacagtcgtattcaggccctcagataaatgtgtttacataatggttcactttttctcattgaaattgtgcctgttggtaaccaagtcacctgtcataactgatgacagacagacatagcaacccgatatgattttcccagggctgccataggaaagcatcacaaaccaggtggctttagacagcagacattcattctctcacagtctcagaggctggaattcagaaatcaaaatcgaggtgtcagcaggtccccaccccctccgaaggctgttggggaaaacctgtgccgtggctttttcacagcttctgctgttatgagcaatccttggcatcctgggcttgtggctgcattgctccagtctcgcttctgtctccacgtggcgttctcgctaggtgtgcgtctcttcagtgtctctcctctgctctttataaggacaccagtcatattggtctagggcccaccctaatgacctcatcttaacttgattatagatgcaaaaaccttattttcgaataaggtcacttcacaggtacagaaggtcttcaggtgatcctctactgtcaggacagaaattataggaggaagtaaccagaaccagggaggtagggaaggggctggaggagaggaaatcctaggagagggagaagaaaagagggcatgagggggataaaaggagtactcaaagctgccttaccccagcctcaagttccagcatccacagtgcttaacatctaaaccacatgccagaaagtactattgcctggaggggagtcttagagttgtgaggcaaagttctaagaaaaggaggtggttcaaagcagagacatgctaaaatagaggaagccatctgttcatgtttcccccaaaatctaaccttcccctgctgccctggtactgtaggcaccttgaagctcctccctcttcactctttgctaaagcaatgaacccctctttccctcatgctcgtgcaaattgtgtgcatgtgcaactgagcttgaactttattccagccctggtgagccaggctcaacctctgtcttggccacatattgggtgggatggacctatgtgtacagttggaacactgacactgaaagtcaggggcctcatgcatcagagggacacacaaaagtcgtcacagagaaaaccaggctcattgtagctgttacagtgtctcactattggcagcaccctgtggggggaaatcaacccattcattcatttgctagttcatttgttcagtgtttcttcaacactcattatatgctgggaactgttctatgcagttgggatacgctgatggaccaaacagacaaatctctctcctctgggagctgatgttttacttatagtgggaggcagcttgtatgaaatttgggaagtctttctcaaaggcaagaggagataggagattcatctttaatagcttcctcctccgccgggggagggtgtcctacagccaggacagcctctcctgtggtcaagactggggtatgtgctgcagcagggatttcccataacatgacccggcccctatggtcctggctgaataccctacccctctccagatctgagcggcagtacatacctgagagcctgggaacccatctttgtgtccaggtaatttgcgtctctctgttctgctctgatttggacattgattttgagtgcaagctattggtcatcttcctattgtctttcacatatcagccataaaccacacatttaatgattattggctagattaaatttttttccatgtagttgttaactatttatgtgttatttctgaaacattgttttctaactcatggtccttgctgtggaggcagagacctaagtaaggctgataatgtggtcagttttggagccctgagccagagtctaagctagactcatcattctcagttctgtcattttagactggcaccttttagtagaaacattatgtgagtcacatatgtaatttaaaattttctattagctgcatttaattaaaaaacaggtaaaattattttaataatgtatagttttagtaatatgtaatccaaaattgtatcatttgaccatgtaatttaatataaaaatatgaacaagatattttatactttttatactaagatttgaaatacagcgtgcattttccacttacagcatgtttcagtccagacgaatcatacttcaattgctcacttgacaaatttcagtttccttatttgcgtaatgaggggatacaaatacctgttgaatgtcactctgaggataaaatgagcttatgtgtgagaacttctggaacattgtaggggatcaaaaaatgtcgagcagcctgggaaacatatagagaccctttctctacaaaaacttttaaaacattagctgggtgcagtggctcatgcctgtcatctcaactcctcaggaggctgaggtgggaagatcacttgagcccaggagtttgaggttacaatgagctatgatcatgccactgtactccagcctgggtgagagagtgagactttgactctaaaaaatgaataaataaatagacaaataaatgtcaagccttcctcatcttcatattattcattcatcttgggcatgctagatacagtaaatgtttgcttcaaagtatgaatgaagttttaaaacagatattagcttgtccatttttttttatttcattatttttctctaactgttattttccttttattttctccctaaaaattccagggagattactctcctggaggattgaattttgtctcccccagcaaaatatatatttaagttctaacttaaaagaggagaaggaatataggggtagcctctttttgtgtttgcagggaaacaacgaaacaaggcatgttcaggaaatagggaggaatctccatgaagaacaacatatatatagggttgggggaagagaatggcaggaggctgcttgggtaaaatccaagaaagccaggtcataggaagggctgaggtgcggggttattttgtctgccattgtatcttatccagtgtttgcatttacctggaatctgccaagaggaatttcagcttcattcaaaaatgaatttgaatcattactcaaaaatccaagactccatactgtaaatggaggtgcccagttctctattaggacaaagtttgatagagcttctgtacagggccctttacttggagatgatagggcatcctttctccctctccagcttctatgcaccctgtgagaaactgtaggctttggtgccttttttgtttccatttttactatagcacaaacaccattataatagcatttctaagactctaaatggaagaagaaacacccacagtcccacagcccaacatatccacctgttttaagtccttgtccacatctaggaagaattttgtcctggttgttattatattgtagatacaatctgataacatactttcttccacttagcgttatgtcaaagaccttattttttccacattgcttgtcttaatcattatcttattcagtcactatgtaatattttatcaagttgatggaccctaatttacttacccaatcccctattattggacactgttactctaatacagataacacctttatctctttaaccaggagatcaaaagctgacaaagcagatacagccagagtcagccatgaattatgcatagggccaggttgcaaacaatttcttctatttaacttaggggcagcaaatagaaggccagtcggtccttggaggtagggagaaactgaactgtgaggtgaacgagtggattttcaaagataaatactggggtttgatgatgttgggaagtacagttttttcctgtggcggctgtaacacattatcacaaaccctatggcttcaaacagcagagatttattctcttacaattctggaggtcagaggtctaaaaccaaggtgtttgcgggcttgatttcttctgcaggctcagaaggataatttgttccatgcctttcttctagcttctggtaactgcagtgacccttggcttcccttgtgtcattgacacatcaccccagtctctgcctcagtcttcacatggccttctcctctgtgtgtctttcctcttctccatttataaggacacttgtcattggatttaaggcccaccctactccaggatgatctcatcttgaaatccttaacttaattacatcagcaaagagcctatttccaaataagatcacaattccaggttctgagcagatgtatcttttaggagtcaccattcaacccactacaggaagagaaagcatttagatttatgaacacagttctacattgcaagtttgtgctatatacatgttgcattctaacctctttactcaacaagataacattgtctttttgtatcaatatatagaggtctcttatgttcatttttcttagtcatgtggattaataatgtttcacccctataaataatgatggagatgaccatcctcatacagcatcactcccatgtacacactttgtccaagatagctaactagttgtgctaacaacttctttcctctacaaacttaaaataagaatttcatatatgtatgcaggtatgtatgctagcatgtattgactatttcctaaatgccaagtcctatgctagcatttttatagattatttcatgtaattatatcaaaaccatctgaggtcattactattattataatactattcttccccactaccatgcaggagaacaatgttttccagaaaggcagagcaactgggctagacgtggtggctcacacctataatcccagcactttgggaggtcaaggcaggactgtcgcttgaggctggaagttcaaaagcagcctgggcagtgtagtgaaaccccgtatctacaaacaaacaaacaaacaaacaaacaaacaaaaaagacaaaaagcccagctgagcttggtggcacatgcctgtagtcttagctgatttggaaggctgaggcaagaggatcacttgagcccaggagctcaaggttacagtgagccataattacaccactgcactccaccctgagcaacagagcaagacccttctctaaaatcagtgactaaatgaataaaagtaagcaacttgcctatggtcccatagcaagaagaggcaaaactgggatttgaacctaatgcccaaccattgccctaggctctactgctgccttttacttacatgttccttcagttctatttctggactctattctgtagtattttccgttgggctgttctgcacgattaccatacagtttcaccttctgtacttttccaatacattaccaatatttgatagatctatctcccgctatctttttcaaacactttctggatattctcacacacttatttttccagataagtgggagagaactgtaagttgcaatagaaatcctactggatttatattctatctgcattgaatttatagattaatttaggaagaattgatacctttacaatattgaatttattctgacttcataaaatctttcatatttctgagtagaatttcatagctttattcacataggtacttcagatttctagtttcacttgctcctagattattttttctgatgacttttatgtataggattcttcttgcattacatttttgaactgatcattacttcctttgcattttctgtttattgtacattgtgaagctactggcttttcatgttaattttataaccagctcccttagtaagatcttctatttattttctaatagtttttcagctgattcaccaaggctgacctgcaaataataactgtttttacctcctttttaaaaacaggcataccttttatttcagtctcttgtttaattgctttggcacttatatctggaatagaggacatccttgttttgttctgaatctaatagaaatgcttggattatttcaacattaaacagaaagcaaaatttggatatgagatacttttctcttttgtcattttaaaaagtagctgtttgtttccattttaccaagccttttatcatagatagagattgaatttcttaaaacccttgtcaatatctactgatattcatccatcaagtattggttgagtagtgctaggcattctgtagacagtaaacaaagtcttggccgggcacagtggctcatacctgtaatcctagcactttgggaagcggaggcgggctgatcacctgaggttaggagtttaagaccagcctggccaacaaggcaaaactccgtctatactaaaaatacaaaaattagccgggcatggtggctcctcgggaggatgaggcaagagaaccgcttgaacctgggaggcggaggttgcagtgagccaagattgcgccactgcactccaacctgggtgacagagcaagactctgtctcaaacaaaaaataaagtctctactctcgtggcgagtgatggttctgggctggtaggaaggtgacatatcaaagatagttcaagaaggctagttctctgtggaggtgttctttgagtgaggtttgaatgccttgtagggtgagccatgtgagatcttgggaaaggtataaaccagtaggatcagaaatgatcaggtgattttctgttggatctcttaatgtggtaatgcatgaatgcacattttctaatattgaaccatcttgcacagctgaaataaatctcattttatcataagatatggtattttattgagctgctcaagtaacaatatttaatttaaaatttttgcgtccatattcataagtaagattggcctgggggtttttaagcctaccttttgttaagttttgctatgggggtgagagtagctttaaaaaggaattcctaaattgtctttcactttttatgtcctagtaccatttcatggatataggaattacttttttcttaaaggaatgaaaatactctttcctaaaactgaatgtcctggtgctttggggagagtataggagaagcactcaaaccactgggatattcttgatattcttatgtgttttagttcattttacgattattgatttatttagcttttccatgtgttttcagtcaaatttgttcatttgtggtttcttggaaatccatccaggttttcaaataaaatggtggtagggttgggcaaaaatatcgtgccgtatcactctaatgtcatctttgtttctgcttgtttgcccaaataaataattttgtatgtgtttaagtttcaaaaaatattatctataataaaatgtaccatttctaggaggaaaattaaatgaattttgataaatgtatagttgtataaccactaccactattgaaataaaaaatattttcataatcccaaaaagtttccccatgcccctttaaaattaattcttccctgtgctcggccctgaaaaccagtgatctgctttctgtccctatagtttttctgtttctagaatgtgatgtaaatgatatcccacaggatgcagctttttgagtctgatttccttcatgaggcatcttgctgtcaaggtttagccacgctactgcatgtattagtactttacttcttatttgctgagtagtatttgattgtatgaatatatcacagttcatccattcatggatagaaatctgtgttgttcccagttttgtctactataggtaaaactgttatgaatatttgtgtacaagtctttgaatagacatacatttttatttctcttggataaatatccaggatttgattttctgggttatatgtaaagtataagtttataagaagctgcctaactgttttccaaagtggttgtaccattttgcactgtatcgaagagtcccagtcatttcatagccttgtgaggacttctcattgtctccctttcccctgctttggccacatgagtaggtgagtgtgtaagtgattagagctcatagtggttttaatttggatttccataatgactgatgctgttgggaatttttcatgtgctttttgtccttcacatatcttctttgatgacatctttgttcaaactgcttgcctatattttaagttgaactgtctttgtaccactgaacttcaaagttctttgtgtattctggatacaatcatttatcacatttgtgtgttttgtatatatttcctccctgtctgtgacatctctttttatctttttgacagtgccctttgaagagcaggagtttttaatttcaatgaatttcaactaatcaacctttctttgttttgtactttatgtcatatctcaaagttcttggcctaacaaaggtcacaaaatgtttcccctatgttatgttctgagttgattattatatatagtgcaaggtatgggtctaggttgatttcttacatatggatatctgtttaagcactgcttcctaaaagtactattctttctctgatactattttttttttgtagatatttggtagaattccccagtgaaactgttttcatatggatttttcttggtgaaatgcgttacctaattcttgagtgagatttggtagtttgtgtctttcaaataatttgtttatttcatctgtgctatcaaatttattggcattaagtgcttctaatatttatttttccttttaatatctcaaagatctgtagtaatgttcgtccttgtattctcgatgctaacgatttgtgtcttctttcttttctttctcgatcagtctggctagagacttgtcagttttattgatcttttcttttttcttttttttttttttttttttgagacagggtttagctcttgttggctaggctgtagtgcaatggtgcgatctcggctcactacaacctctgcctccctggttcaagtgattctcctgcctcagcctcctgagtagctgggattacaggcgcacaccaccatgcctggctaatttttgtattttcagtagagacagggtttcaccaagttggccaggctggtctcaaactcttggcctggctaattttcatattttcagtagagatggggtttcaccgtgttggccaggctggtcttaaactcttggcctcaagtgatctgcccgcctcggcctcccaaagtgctgggattacaagcatgagcctccatgcctggcgttcatcttttcagagaatcagcttttgattttaccatttgttttcattagttttctatattcaagttcactcatttctgttcttacctttagtatttccttctttctgcttcctttacatttattatgtacttctttttctagtttcttaatttagaagcttaaattatggatatgagaacttttctgttttctaatataagtattttactgccataaatttacctctaagtactactttagctgtatcccactgccacacatagtttgacatgatgcgttttagttttcaatcaattcaatgtgcattagcttttctagtgatttactctttgatccatggattaagaagtgttttgtataatttacaaatattggggaatttttcagatatctttctgttattaatttttagtttaaatctactatagtcagaaaacacatttcctgttattgaagttcttttaaatttgttaggatttgtttcatagtatggtatatggtctatctcggtgaatttgccaggggcacatgaaaagaatgtatatcttgctgttgttgaatggagtctgaaataacatcacttaggtcaagtggttgaagttttgctcagattttctctaattttaataattttccctctacttgttctatcaattactgggagaggaaagttttcaaatatagttgtggattttcatatttctctttccagttctcagttttgttttatgtatttttgttggtggtgtatttttgtttcgttttatgtaactgctgttaggtgcatttgtacatatttttatatttctatttttattgattttattagctgttggctcatctacattattatctagatggaaatatgtttgatttccaacaaattcaatctgaatatgtcttttaaacctactcctttgttacttttcttttattaattcctccttctgagtacctcagaatttcatggtatgcttttttcaccaatatttttgaattaaatgctttcaataatttattttcacccttcctatatgtaatgaaacaatgaaatatgcagttttggcagtattccctaagtttttgcatgaaacatcatagttaccgttgtttttcaaaatttctggaacaaaccgagattttgacttctttgaatcaaatttttattatatatttaaaattttcctttttttccaagtggtttgggttgtttgtttgttcttactttcatgatttctttttaaatttactgagttgtactcagagactgcagtctgctccatttctagaattaaacaagttttcttttaagccaagtagatagtatgacagcagctatagacattaagtaacaaaaatgtgttgctatattctaacaaaactttacaaagatagagcaaaggttgaatttggcccatggccatgccaaactctttcctgaagggaccaaccaaactctaatttgcatcatcttagttccgttatatttcctttaacattcttctaaaactacatcagaaacaaaatagagacacaatttatttcagactgctccacctttcaaatattttgccttccagcaacctattggcacttttataatgcaagacattgttgatatatcagtttgtataaataatacttttttttttttttgcgacagagtctcgttctgttgcccaggctggagtacagtggcacgatctcggctcactgcaacttccacctcccgggttcaagcaattattctgcctcagcctcctgagtagctgggactacaggcgcgagacaccatgcccggctaattttttgtatttttagtagagacagggtttcactgtattggccaggctggtctcgaactcctgacctcatgatccacccgcctcagcctcccaaagttctgggattacaggcatgagccactgtgcctggctacaaataataccttcaatttgacattattttggattttgttctaactttttttgattgcaatggtataactatttcaggataacaagcccacgtttaatagatctatcagtggtaaggtctgaatgtgttccttcaagtttcatatgttgaaatttcatcatcagtgtgatagtattaggaggtgagacccctaggaggtgattaagtcatgagggcagagccctcccatgtggggttagcgttcttatgagagagatactggggagctatcttccccttcacccatgtgattacccaataagaggcacatcttgcaagcgcagagcaacccttatcagacaccaatctgccactgtttatctaggacttatcagatgccagaactgtgagaaaataaatttctgttgtttataaattacccactctcaagtattttgttatagcagcagaaggcagaccgagatagttagataatctttttccttataatttcatttttgtattgcaagatggattggtctgttatcaggtttaattctctgttcacccatgtatagccaatatataattttatcctaataggaaaaaaaaaaaacacaggatagatttcacacaaaaggtccagtttcctatctaaaggttagttgttttgaagtgatcattcttcatatgccttgtagattccctgactgcatgccctaattttgttgccagcagaatacttactttttcttaattttatcaagaaaacatcaccttacatattaatctaatttctttaaataagatatacacagacacacatacacacacacgcacgggttttactgaattaaaattccatatttgtcacttactatatactcatataaaattgaatctcttctggtatttctgttttattctactaaattattatttctggaccaataatatacaattttatttactttattgtaagcttaataaagaaacatcgtggttcctcctacttttacagttttcttggttttcttagacatatactcttccatatacactttaaaatagtttggtagttaattttatgaattaaaattatgaagattctgagtgaaattgtatttcatcaacgtattggttttgggaagactgacatttataatattgagtttgctcattcatacatgtggtattttaaaaaatttgttcaggacatgtttttatatgtttcaataaaatttattagttgtttgcattttaatatctttttaagtttagaaccattcccatcaaatgtattttttccttgtctcatattatttaagtcacattatgattgggagtttcttctgatttttttattattgctcttgattttttatgtacttagatagattctagccaaattatcagctcctggataaattctagacattttttaagtagtcactcaagttttttaagtttagagtcacatcatttgtagataaattctattttgtctcttctttttaaaatatttttcctgagtatctcatttctttactaagtgcattggcttaaccaccaaaacaatgttaaatagaaatggagatggtaagcatacctgtcttgctcatgatattaaaggaaatggtttcagaattttgccccttaataaggggttcactgaagtttttttcaaaagtctttattatatttaagtactgcccatcaatttctgttttggttaaagttttcattaggaatgtctactggattttatcaaatgtatcctggcatatacatcaatgaaaacttcctctgtgacaaattccaggaaatcttaacccaaattgactccagtgaaaagtgaatgcattggcttttataactgaaaatgctcagaatgaggctggcttgagaccagcttgatacaagggttcaaactgtgttatcaggatcaggtaactcttacagactcttcccccgtggcccctcaatcagctgcaacaactgtaaaactcgtaagcatttagcttcaaatctagtggtagaggaagagatagggattcctagggctcccagaaaatattttattgcatctctctgattggtacgcccatagtcttacctctaaatcacaatcattaagaccagggaaatgtgatgtgctgattggctcaaatgtagatcacaagcttcacccctgagctgggtaggatctcatcccctctacatctgcttaaaggagatgagcaggtggattcccagaggaaagctttggtaacagtcaccagaagaagggaaaatagctactgggtggcacaataacagatgtcacttcactgtctattgattcaaccagatggcttttcccattaatttctgtttgtaatacattgtcttaatatatttgttgatgatgagccatgcttagaataatccttgcttagtcatggtttgtactttggatgcactgattgattccatttgtttaacattttccatctgtatttataggtaaaatttatctctagttttatttttgcattatttgtatcctgttttggcatgaaaattatgttggatatataaaatgaatggaaaagctttatttttatatggactgagataatttaaatattatcagagttatctttccttaaaggatatatttttaaaatcatttggaaaaaaaaggatctagacctgaggtggtttttataaaggtatttaaataactttcttaaactgttacgtgattttcttctcctcggttgaatttcattttatttactagaaaaattatcactctcgaaattctcaaatttcttattacagagttatacataatattttaaaatttaatatcttgtctatttatggttatatcacctttctcttttttaatatgttatactctcttattttcatttgcttcaccaaatgtaccatgttttttcaaaggacgacctttgattttatttagatacatgttttttctttatgtcattattattgtttacttcgctaaaaagaaaataatgtcattatttttagctcttatattcttctaattttattttgttattttgttcctttttttctaatttgtaatgttgaaatgcttggatcacattactctggatatatccctagctgcctccacgtgttttggcatgaaattgtctctttttcttgattatttttaaaatagtttataatttacatttggatctcctgtttgatctagggtctgtgtatttaagataaagtttttcagtttccaagaagttaaggctttctttttaattgaattatattatgattagaaatgtggcctgcaagttagaatggtgatcattaaaaagtcaggaaacaacaggcgctggagaggatgtggagaaataggaacacttttacactgttggtgggactgtaaactagttcaaccattgtggaagacagtgtggtgattcctcaaggatctagaactagaaataccatttgacccagccatcccattactgggtatatacccaaaggattataaatcatgctgctataaagacacatgcacacatatgtttattgcggcactattcacaatggcaaagacttggaaccaacccagatgtccatcaatgatagactggattaagaaaatgtggcacatatacaccatgaaatattatgtagccataaaaaatgatgagttcctgtcctttgtagggacatggatgaagctggaaaccatcattctcagcaaactgtcgcaaggacaaaaaaccaaacactgcatgttctcactcataggtgggaattgaacaatgagaacaggtggacccaggaaggggaacatcacacaccggggcctgttgtggggtggggaaattggggagggaaagcattaggagatatacataatgtaaatgaccagttaatgggtgcagcacaccaacatggcacatgtatacatatgtaacaaacctgcacgttatgcacatgtaccctagaacttaaagtataataaaaaaaaagaaaaaaaaaagaaatgtggcctgcgaaatcacttgtataacagaatgtatgatgatttctttttagccaaatgaacaatttgtatatataaatttacatatatttatatttatatctaaggacataaagactgtacattcataggacttcaagttcttttagtgcataatggtgctatatgatatgttatatatttgtgtgtgtgtatatatatatatatatatatatatatatatatatataaaattaattggccctctattcacatgcttacttttgtctcatttatctgtcatgacaaaaaattaatctcactactggaaaaaataaaatctcatacttcagttgtttttatccaattttgttttatatctttggcttttgtgttgtttatgactgttacgtttttcaagatgtctattcaattgggattttcaattgatattgggaatttcaattgacattttgaaaattataagacatagcagtcatatttagttccttacatttgaaattttcttgtaatttgtcaaatccatacaatgttagggttaggagaattcttatgtgcaatgtagactagcctcttgattttactaatggggaagctgaggccaagagagcagaatggccttgtctaaagtcatacagcttgaatttgatgaatctggcctctttccaccacatcacattctctaagtgccctgtagtcaaatttttctatttgatgctgtaagaatagatgatctggcacaggcaaaaaatggaaataatgaccagaaaaccataatttttgtttaagaatgatggttgaatgaatgttggagggtgtgtggaggtgagatctttactcagtcattcaagcacccaggctctttttatttggtgtcttcatcatcccctaaggcattcaagtcccctgcagggtctggatggctgaccagggaaaggagagtgatggattccacacaggatctcatgaatcaagcctagaagtggtatagtaacttccacctctttttcattggtgagaactcaaacatatgaccacagctacatgcaaagctttgtccaactgtgtgcccaggagaagaattagctttggtgaatatctagccagtctcaaccatatcttgttcttgggtgaacgggtctgaatttgaatgtggaagaagctcagctgagtccagggcttctgttgatctggagatcagaatgaagttctgagtttgaagaactggagcttttgttggaaatggggtcaaaatcccagagggcctagaggggtgaggaggtagactcccatagaatgaggagaaaagagcccagtatttttctaagtacaaaaggcagcaggataagccatcgagtagtgagaataggtcacctgtaccaaccaggcaggtttggatagggccagattagaaagtcagaaccatcactactgtgagcgaatgtggtggagaagaagagtggaggtgagaaagcagagacccacaggtccaagtccctgcacttttctacaggactttgtctacagatctggtcattgaagagggttttggtccctgttgcccaaggtattatgatgcttgcattttaaagggagcaattgaagactgaaagtcttcaaagcagaaagggattcatttatccaatattgaaatgtaaccatgaggtcagattttaaatcccacatactttaaaaagctcatccacacaacctgtcaccttgtcttcatatgtaggtagtagtagtaactatttgatgcacttgaggaaggtatctgtttatctgtgatatgcttaacagtacaagtccaacatagggttaaaaaaacacttgtgctcacaaagctagtcattgtggtatcatttataattgtgaagaaaaatctattggaatatgaacaaatagagaaatgtttaggtaaatgatggtatttgcataccatggaatattagagtcattaaaaatgttgataaggatgttcaataatcaaggatgcaagtttacgaaataatataagcaatatatgcaaaatgcaaaaatcgtatacctagaatgactgaaactatgtaaaaatgagtaggaaaaagaaaaggggggaggtaacacatgaaagtattaagatttcttgggtaatcagactaagactttttgttttcttttatgtattatctacattctctaccgtaagtattgcattgagaataattaaataatgattgccttcttaaaactgtgccatttttatatatgacagctgtatattttaacaattcacagaatcagatgttatagtggtccttgtaatacccacatgctcatgcatgaacatatacaagcacacgcatgtgtatacacacacacacacatgcacatacacatgcacacacacacccccccaaaccacagtccccctgagagagcaaaacacaaagcggcatgagtagcagcagatgttttcacaaatcctgcaagttcctccagattaaatgccttacaatccacaccaagcattattatcgctttttctttgttggaagccagactgttgagtcccctttcctcttgtgtgcccacaccaccgcctccctctctgtcttgtaaatgccgcatattattggatgtgggtcattgggtcagtctcaatgcctttcagaactggctcaatactgaagtctttagctgtcgctgacttttcctttttttttttttttttttttttttaactgcactatcctccctgagcaaacagggcatctttctgagaatgatcatataaatttctttgcatttttcacaaatgtgttggttgcatgctcgcctccagcctcttgggcccaattatctgaaaataggccctcatctgttttagcacaggcttggttggttacaaataacagaaacccactccacctggcttaatcaagaggacaatttgctggaaagatataaggctaacacaaatctcaagtcagggatgttttggggaaccaaaacccacaacagaaactgaggcagtggctggctctgagtctctgtccttctctccccatctcccacacctctgtgctctctctgcaaacttgcttcattcacttttctctattctctgctcccctccttcacctggcagaatgtgccattgtagaccacctaacagttcttagcctgattagaatcagagcgaaccaatttcaaattcccaccactaagggtctgattgtcccaggacaggacagatgtccaccagctgtgaccagtagggtagagagaaagctctggaaaaccaagacaccctgcttccccagcaaagcagcagttacaaaatatttaagataacatcttacaatgtaacactgtggcaatcagtttcaacggcttaggcttgttccagtgatctgtcttctccacttggctggtgatcgggctggcagtgacagagatgatgcctggggatttaacatcctttggttaagcctgtactgggcacatccattgcaacatgccatcctctctgctaaccccatttcctaaaggaggggattggggctcggagagaacaatgtctaagttcacattgggttcatcagctgcagagaaggtgtttgaatccacctccggctctctgttcacttgttcttcagtgctctatggctgcctttcgtgtgtgtgtatgtgtgtgtttcctgttctgcaaagtgctgattaaaaaataatgcttgtattttccttacagacattattactgtaaaataattaggtagaagcagtttgaaggctatggaatatgatataaatattattattatcattattaacactttttccactacctaactccgtaacccctgccaaggtttacgttaaacattgtcttgagttggcagaactttccttgcatattatcttgtcagggaatattcagaagagatggtggagagtgagggaaaagggggataaatcagtaagcttcggagacattaaacctgtaatgcgttaagatgtccatcccgatagagacttttttaaataaaggtttgtttatttatttatttatttatttatttatttattactgttttgacattttttagttactccaaattgaaatctgcgtcaacctatctgcttatcaaaactgtccctgctcctgtgttcctgtcctggttaaaaagtagacccaacacccccaagccagaaacctagggggtcctcggctccaccctcctcccgaaacccacatctggccactaaatcctccttccttccttccttcccagtatagcttcatctgttaaaaacccgatcccttatccctactgtagaattactcccacactgtttcactgtctttctttaactcgtcctcaaggttgctaccaactttccaagatgtgcatttgatcatgtcacactacctgctctaattccctccataactccattctctaaagcctgaggacttagtgtgaccaacaagacctttcctttctcttctttttcctgaacatgcaagcgtgcttggtattccctcaatacaccatgagcttccagttctcacctttgcaaagacaattcctcttgcagggatgttccttcatactctctctgccctgcacagtccaccttatccagcaagatgtggcttcttggtggtgtctttcctgacctactcagagacagatagttctgttgtcccctggactccccagtttcgcatatatctttgtttgcccttgctcacaaatgtagaagtcatttaaataccatctcctctctaggcttgaactcctcaagggaagaaattataacagactcatctccctaggacatagcataggacctagcaaaatatggcttcttaataaaaattatcaaaatagttgaatcaaccaatcaactgtgcttgtctagggtcatgcttgctatgaaaaaaaagtcatatggaagtcccatatgattttttaaatgatgtccctgaattagacactggaatagttttgccttaaaaatcaatgatcagttttactccacattgctgtctctttagtaaaaagaaaaaatgtaatctggcacgggtaatgcccatggctccgagttgggttaaagacaacatgaggcatctgagaaccatgtcaaacactgatgtgggcagtactgatgagtgcatttcaaagtggaccaggctgtgttttcttgtctgcctggaatgaacatctggactcaactgttaacattcagtccaatttgttgctaaggcaaccaagttacaggccaccctcaatttacaaaagatgatattgcaaaagtcatcttataagtcagatatttgaaagacacaatacattcttccgggtgaaaagtgatgtaaatggtggctagaatctagagaattgtatttaacccacattgttgtagtacttgtgcaagatgagtcagtaaatatatctcatgtctccaggtcacagcaatagtctcaaaacaatttggctgctaggaaaaaaggagcctctctccagtattcctcaaaatgagtctgagccctcaggatatcctgtgtttagtgcaaagatttcaaaaccaggttaagcatctggattacctgggagggatttaccaaaagagttattagtccaaccccaggcctatcccattgaaatcagaatcctctgtgggctctaggagtaagtgtatttttaaagctccccatcccaggtgattctggtgctatttctgaactgttatttagacttcttggtttgcactgccattttctcctcccctgccttggcactaagggtggcttctcatattgctgcccaagcttaaagctatggttacataggtgataaactctgagggtgccatagttcctaccgccgaaggatgacctttgtgatagataatctgttacaatgcataaagtgttatagtaatggttctcagtgaatcatacatccctatgcccatgcccatgcccctttgcaatgtgacattgccactcttctcagcaagaggcggagcctaagtctccagccccttaaatccacactgactgtgaatctttttgactaatagaaagtggtagaagtgatgatgtgcaagtctagaaatgaggttttcaaacgccttgactgactaggaatgtttgctcttgccctcccagtgtctggggccacctttctgtgaagaaactcagtctggtctcctggaaaatgagaaattaaatgaagagaatcagtgtcctaaccaacagtcaggaccaactgccagttgtatgagtgaggccatcttggaacatgcagcctcagctgagcttagatgactatggctacttgaatgacatcgagcagttctagcagaacagctcaggttgctaactcagaaaactataagaaataatcaattattgttgttttaagccactaaatgttggagtaccaatagatacctgattcagccctatgtttttttaaattaaaaaatacataaatttaaaatggaaaattattacacatagagtctctgtgaggaggtaattattgttattaaagatgacttccttccagaattttaatattcagatcaagacatatacaaagagattttgttcttgtcgatgcgccatttgaattctgatatacatgctattttgtagcctgcatatttcatgaaataatacactcatcattttcacatctcaaataatattttgcatcatttaatgacgatatagtactccatctttgagatgtacatactttatttaacctgctcctgtttttagataatttttggctgttatgctcaatgctgtaatgaaaatccttgcacataaatcttcccacatgtaaatgattattttgttaatacattatggctactgctgcttgatatttttgccaatagaatagaaaaaaacccataccattttaatttatttcattttattaaccattagtttaatcagatttgtacacatctattggttattccttttaatctattgttttattaaggaatgatcctctcatgtatgtatttttttttacaattttttttgtggaacagacacacataccttgaggtagtataccacagacaatagatcatcaaaccagatactacctctgctactttctagttatttaatacaaagtatgttaactacatttttcaagcctcagtttcctcaaatttacagtggagatactaggtgcctatttctttgaatagttatgattttgatgacataagaaattgcccaagaaaatgactggtacaaagtaagtgtctactgttagtggaaattaaaattagtccagccactgtggagagcagtttggagatttctcaaagaaccaagagttgaactaccatttgacccagcaatcccattactgggtatatactcaaaggaaaataaatcattctgccaaaaagacacctgtgatgtatgttcatcacagcactagtcacaatagcaaagacctggaatcaacccaggtgctcattaatggaggatcaaataaagcaatgtgttacatatacaccctggaatattatgcagacccgaaaaagaaatgaaatcatgtgctttgtcacaacatggatgcaactgaaagccgttaacttaaactaacacagaaacagaaaatgttctcacttataaatgggagctaaacattgagtacacatggacataaagatgggaacaaagacactgggaatttctagaggggaagggagaatggagggtggtagcaagggctgaaaaactacctattgggtactacactcactacctgggtgacagattcattggtatccaaccctcagcatcacgcagtatacctttgtaacaaactggcacatgtacccctgattccaaaataaaagttgacaaaaaaattacatatccagtaactattggctttcctagagatttgtttcacaaaaacaaaaaattgtttataacctgtgtgcattttaattaacgcaatattttcatttattcaccaaacacatgaatacgcatcgtaggtctagcatttttccaggcactgaaatgacagtgggaaaactgacaccatctcactggagcttatgttctagttgagtgcgacagatagtaaatgaatatatagtaaatcagacggcaataatgctgtcaggtaaaaaaaagcaggataatggggacagggtgtactggccacctgtgtgggagggacattttattttcaatgaaagacctggctttaaaggtggcatttgaacagagacctgagggaaggcaaatttctgtctggaggaaggctgttccaggcagtgagaacagaaagtgcaaagtgaccgggctcagtggctcacgcctatagtcccagcactttggggggccaaggtgggcagataaccatgaggtcaggagttccagcctggccaacatggtgaaaccccgtctctactaaaaatgcaaaaattagctgagcatggtgttgggtgcctgtaatcccagctactcgggaggctgaggcaggagaatcacttgaacccgggaggcagaggttgcagtgagctgggatcacaccactgcactatagcctaagcaacagagcaagactgcgtctcaaacaaaaaagaaagtgcaaagggcctcacgggagagactggttagcgtgttccaagccagtgtggttggaatagagtgagtaagggaaagagtggaagaaactaatttggctttttgtttaaatggatcatgttgtctgctctgctgacaacaagctaaaggaaggcaaggatagaagtagagaggctgctgagcaggcattttaataatgcaggtgagagatggtggaggctcagaccaaagtaggagggagtgatgagaagtagtagaattctagatgtagttttaagataaagccaatggaatttggtagcaaagtaggtttgggatgtgaaagaaagagaggaatcaaaaatgaccccaggtattttagactgagcaaatggaaggatggagttgctattaactgagataggaaagacactggaatgagcaggtttcagagaaagattgggatttaggtttggcatctgttaagtttcagatggattcctgttggatattttgggtgagatatcaagtagacagatatgccagtctggagttcaggggagaagtagaggacggagatgttagcaggggagtcagcctatgcacgagctttgcagacgtaaagctggaggaggtgaaagggtctcagtgtaggtagaatagggagattctagtgctaagctttgggacccttggatttttaaggtggaaaatttgaggcagaatcatcaaatgagacagaagtatcagccaatgaagtaagaagaaaaatgagggcagggtccaggaagccaagtaataaaaaaagaacaaaaggagaaggtgatccactgtgtcaaatgctgttggtagttcaggtaaaataaggactgagaattgaccattagatgcagcaacagagaggtcattggtgagttaacattagcaatttataaagaattgtgggtactgaaatctgattacacaggcccaagggagagcagcaggagaggaattgtatagaaagatacaaagaaggcagagacaggagacagtacctgaagatgttctctgatcaaaaggtggggagttgttggtattttataaaatttgagaaatattagaactaaagggaaatgatccaatggaaagggaaaaagccccaaagaggatggacactgctcttgggatgacgtttggtaaatgagagcacagggggtctcactcacacatagaagagttggtcttagatgcggcataggtccttctgctgtagaaaaaggagggaagacagaatgtatggggatgggtcagttaagctgacatgtgccgtgttctcaccatggaacttccattttctctatgaaacaggaagcagggttatcagctaagagtgaggagagcgtggaggtgttggaggtttgaagagactccataaagtaggaaacagtgtgggagtctgaaaatgagactgaaatggggaaatgtaaaggatcaccaggaaataccaagggagcacttgaggttagcagacaggagttacaacgagaccagttagcatgggtcactgctttcctcacacttgtccagcagactcggagtaggcagaaaatatgggcttcagcagagttaatactgtgacaaatgacttaaatgagcaagaggggcaagaacattttgaacatttctcaatatcaatgtatattacatttatatcaccttcattttaatggtttcagaggattctgtaaaatgggctcaatctatttagccagctccctcatcttgggtatttagttttttctagttgttcattattgcactgaacaaataatgattcaatgaattcccctttatgtcactctttgctcatagttttgattcttctgaaagtagtattgctaaacaaatagtaaaataatcagctctaagtaacaaagccaactcaaaatgacttataccatatggaaaatgtgtcacatcatataacaaggtatccaatcatatcctaagctgcggaattgcttaattcattattttaaaaacatcatgattgactcaggtttttctgctctgtcaaccccagtgtgtgggctttgtctttaggctggccgtcctcttggtcagaagatagctgccatgccctcagacatttcctgtggacctggggacatcccttcctaagaatctcttaagcaaatattcccagatgcacaatgtaaatttctgctcacgtttcattggcaagaatgaggtcccatgcccataggttaaccgatcactggtgaagaaaatagttatcatgattgactgagattcttcaatatttattctcgaggtggaataaaccttgagatgggataaagggggatctcctttgatgaatgcatagccacattaaagagtaaataccacgcaaatcagtgtttgccagaagtgaagaagagggccggggagagagatggatattacatagacaagtgtgtcttctgctaaggaagatacacattttcaccatttttgaaggcatatccatcaagtagtaaaattaaaaaaaaaaaaaaaagacctgtcacatcttcatagactttgtgcatttttaccttcctccttatttgttttggacaatcctgccttactgggcatcttgcaggttgtattcgggaatataggaagccgtagtcttccctgactcttccatgcaattctgttgatatctaccctctttactcacccaacgcttgcgaatacagtcagttctgatgtcatgtgacctatacattcctaaatatcgccacgatatgtaaaattgcacactaaaaattacagggcttataggaagaatgaagttaggatacaatatttaaaaactttatcagtgacccaaacaataggaacctaggaaaaatcttagctcagttttagacatgttaaatagctaaggaatacataaatactacaataaatatggtactttactttgaaagagatgcagtctgtgtgtaagtgggcatcagattccaacttgtgtgttattgagaaatggtgtatggaagatcgtctgaaatgggagggaaagttggaaccccagatgtggctgacacacactgtaatctgagtggggaagcagatgtttgaggtgtatgagtgcatacattttgtgtattccttcgtggttggttcatctgagtgcagttttctccagtcacctgcttttctctcctgtgaaatgaggcataatcaaacatttgtgttatgttcaaattattccctaatatacatgcatattttaaaaagggttacaatgaagatggatttactgacttcacaatcgatggggttcagaacatgctacccccaaatatggcaccttggcatttgggtagacagcagaagtaggaggatatctcaccttcccccagccttctcccctgaagaaagtcctaagacccttattccagaggtgcccttcctattcccagaggagaggaacgtccttatctctgaagacacagggggatggagaagaatcgttacaaaatagatcttgctaaattcccttcagtttatcaccattagacaatccccactttttccaattatattttggcacaactgtccactcttcatcaaatgtaagcattaaaaaaaatcagattttcctctttctttgggccttcttttctgaagacttccttgttgtgtaaaacatgtattaaatagatgcgtatgcttttctcttgttaatctgtcttttgttttaggtgcctcagccatgaacctagcaaccgatgaggaaagaaatcttttcttccctgcaccacccatgcccttttctgtccttttccatgtgaattccaccttctgaaagctgttcaaagtttcttgcatatggatgatactccctctgagttttcagggcccgggcaggcttttccaatccttatactgtgaagccataaatctctgaagataggggtagaactaagcagctgtgattatgttgcaatcttttctaggaaccaaagctagttctgcctgactctgtagctcctcacttcttcctatgccaagccaagtgaactgtaggtcattgcaaaatggcagttatttttttaaaaagaaagataaatatgtgggttaaggtaagaaaaatgaaatggatttttttttttgagaaataccaaaagaaagattagtaaagcaaacgcccttcagtagaggaaaatgtcagcctctattttcttatcaaaacctattattttacttttttcccatttttcctgatgtatgctaatagccctcttacctttcaggttcttagttgacttacagaatagagggaggaaacaaagacatttcatgcaaggtctgagaaaaggtagggcaggaaatgttcatatgtgttagaactgagtgagtttaagtaacattttttcctggaattagctgaaatagaagcaagacatgagggaaaacacaggcttgtaggagacaaattaactgtgaggtagggagttggcatcaggtataacagtgggatagaacaagggagggcttggggcaggtgggtgcagcagtacagtgtggtggcaaggacagtgcacccctctctggccattgcccatcatggcagggaggaaaatagagcccgtggcaatgttgttgactcctgtagggcatccgacattagaagctcttctgttggggagaacctagacagtatcatcaatgattaacttgcttatgctcggcatctgaaagaaaaggaaatccaatagcatttagttataggacagagcatttacatctgttttcagtatgtaggacttgctggatgacaccaggggcaagacataatcaggtttcttctattttgatgaatttaataaaacatcttgtctttcaccattgtggctagtggctcatccaagctctatcattgttgcattcccttcctcccgctctttaggctttaaaaacaaacgaacaaacaaaaaactgtggcgtaccctatcactacaggaagtccaagaagaatcgctggtctttggtccctccaggttgcctctgtgatgggagtcgtccaggcctgaggtgccctggaacctttgctggtagtgtccgtgccccacacactaagtttggccgccaggacattggctatggctccagttcctgaggctgccatgttatgtgttcagattgtgacatcaggggaccatgtctgggttcttgcaactcaggtaatcctcctccagcttttcagacttctacacttgtgttcagaatcaagccatgcccctcttctcttgctgctgaagcacaaaagtctcctcctcctttcctgtgaggtgtagtcgagggatctgaaaagtgaactcttaattcctacctggacaagcaagcccagaactcacaatgaaaaggacatttgctttttaattctcattttaaagagttcctagccacgctcctccctctttcctctaaaaaattctcaaatacctcttaattcattaataactcaccccactacatattactcaatttgtgtttaattgtggcccttaaaagtagatattattctgattttaaaagcaatgaaaagacctaagtaacttggtcagggtcagttataacatcggagtaaacctaaataaaataaggttgcaaactcaattctgactccataacctaatttcttagtcctacctgccagcctctcggtcggtactcaagaaagttcctgttctttggttaaatttaaatttcctaccacttaacagatatttattatcttaaacagtttgtgagagtcaggaatcttagagtgacttagcttatggttctggcccagggtctctcttaaagttgcagttgagatgtcagctggggctacagtcatctgaaggttggactgggactgggggatccacttccaatatggtgtactcacacagctattgtcagaggcctcagtatgttatgacatggcacatggctttcactagagtaagtgagccaagagaaaagggaaagaaattataatacatttcatgaactagccttggaagtagcagagtactacatctggatgtgaataacaggaggtagggatggttggggaccatcttgggagctgactaccactgacatttacgttggttaatggaagctggcatttactttggttaatgttagtactgtgtgggtctgcagcaccatggtgacaaatgattcctggtttatactttccttaatcaattaatcaatcaatttatatttttcatcaattttttcaactgaagtagagatgtaatttcataagcataatgtattgactgattgcattctctcttttactacgtgttgattcattcacaagtctttactgattacatgcccagaactttttaattttttgtagtgacagggtttcacctaatatgtgccaagtattatactagctgctgaggatacaattgggagaaaattgaatgctgttcctcaccctcctagagtccgttgcatagggaagaaagctattagatggctgtataagtccatactgtgctgatataaccgaataccacagactgactaatttataatgaagagaaatttattaggtcacagtttagcgccttcttgctgtgtcatcttatggtagaagggcaaaggaagagagagagagacagagagaagagttaaactggcagcctcaaggctttctttctttttttttttttttttgacagggttttgctctgtttcccaggctggaatgcagtggtgtaatcatggctcacttcagcctcagcatcctgggctcaagcaatcctcctgccttaacctctggagtagctgggactacaagcatgtaccaccatgcccagctgtatttcttaatttttttgtggtgacagggtctcattgtgttgcccaggctggtctcaaactcctagactcaagcaagaagtctctcgccttgtcctcccaaagttctgggattagaggcctgagacaccatgccttgcctcaagtgcttttataatcaacattaatccattcaaaaggatagacacctcatgacctaaacacctcccattaggccccacctcccaacactgctgcaagggtaataagtttccaatatatggttttgggggaacacattcaaaccatagcagtaatcatacaaataacatgtctctcaacatgtgatgtgtgctgtgaaagaagaatttagtttgctgtgaaaacataaatcgtggaggacctaatttaccttgagaatcagataagaccctatatcacgtttctttttttttttatactttaagttctaggatacatgtgcacaacgtgcaggttagttacatatgtatacacgtgccatgttggtgtgctgcacccattaactcgtcatttacattagatatatctcctaatgctatccctcccccctcccctcaccccacgacaggccccagtgtgtgatgttccccttcctgtgtccgagtgttctcattgttcaattcccacctatgagtgagaacatgcagtgtttggttttttgtccttgcgatagtttgctgagaatgatggtttccagcttcatccatgtctctacaaaggacatgaactcatcatttcttatggctgcatagtattccacggtgtattatgtgccacattttcttaatccagtctatcattgatggacatttgggttggttccaagtctttgccatagtgaatagtgctgcagtaaacatatgtgtgcatgcgtctttatagcagcatgatttataatcctttgggtatatacccagtaatgggatggctgggtcaaatggtatttctagttctagatccttgaggagtcgccacactgtcttccacaatggttgaactagtttacagtcccaccaacgtgtaaaagtgttcctatttctccacatcctctccagcacctgttgttgcctgactttttaataatcgccattctaactggtgtgagatggtatctcattgtggttttgatttgcatttctctgatggccagtgatgatgagcattttttcatgtgcctgttggctgcataaatgtcttcttttgagaagtgtctgttcatatcccttgctcactttttgatggggttgtttgtttttttcttgtaaatttgtttaagtgctttgtagattctggatattagcgctttgtcagatgagtaggttgcaaaaattttctcccattctgtaggttgcctgttcactctgatgatagtttcttttgctgtgcagaagctctttagtttaattagatcccatttgtcaattttggtttttgttgtcattgcttttggtgtttcagacatgaagtccttgcccatgcctatgtcctgaatggtattgctatatcacgtttcttaaccttagcactattaatgttttggactgggtaagtctttattttggggactgtcctatgcactgaagaatgttagcatccctgggccaggcgtggtgactcacgcctgtaatcccagcactttgggaggccaaggtgggggatcacgaggtcaggagttcgagacgagcctggccaacatggtgaaaccctgtctctgctaaaaatacaaaaaatagctggacttagtggtgggcgcctgcaatcccagccactcaggaggctgaggcaggagaataatttgaacccaggaggtaggggtttcagtgagccgagattgcgccattgcactgcagtctgggcgacagggcgagacttcatctcaaaaaaaaaaaaaaaaagaatattagcatccctgaactctaacttttagaggtcctttacccacacatacacaagttgtgacaaccaaaattgtctgtaggtatattcaaataagtgttccttggaaggcaaaatctcccccaattaagaagctaaaatttgccctataggaagtttccagattaaaaagtgttggagtcgggagagcatttcaggagaaggaaacaatctgttagtgagatttttgtggatacggattttcaaataataacacaaaacaaatgacgacgacaacaacaacaaaaagaccatggttacccacctctacttctgaagttaaaattcaaatcactgttgcctgtatgacttgttgctgcccctttaaacaaaaattcacaccctgtagccagcctgcttgtgctgaataaggtgtcttcatataattgtcaagaaaaaaagcaggtctggcctaaagctgtcttccaaaacatattttaacttattgaatctctgggctggttaaagttgtttggccttcagcctcctggtttatatcactgccccaagcagcgtattaccactcaggaatacatggcctcatttttattggaatgatatttataggtaccgcttatcctctgtatgaatatgtttaatatgaagagagtatataaccaggcttggtataaagtcagatcatttccactaagacttgccttatttcaatttcgaacagataaaaattaatttgtgtgcttagaatcctgaaatctggagcaaaaaaaggaacttagaggatctagtgggaaaatcataggtttcagaatgcagacaattatgggtcacatttggtctcagctatatgatcttgtgatcttggacacataaaacagcttcaattttctcatatgtaatgaagataataattctttttttttgtttgtttgtttgagacggagtctcactctgtcgcccaggctggaatgcagtggcacaatctcggctcactgcaacttccgcctcctgggttcaagcaattctttgcctcagcctcccaaatagctgggattacaggcgtccaccaccacgcccagataatttttgtatttttagtagagacagggtttcaccatcttggccaggctggtcttgaactcacgacctcgtgatccacctgcctcagcctcccaagaagataataattcttactttgcaggatcgttatgaaggtatgaaagatagaagcaatgtcaagcataccatagatgtccaaaaatgaaaggtccctcttccctttggtttgtccagttccactcctctcaggtatccccagtggctgttcccctaaaaatttgagagccagcctgtcctaagaccatccctcatcctgtacctccagaggatcttcaaattctctcaattttacctccatttttagttaggtccccgtattttcttttttaaactcctgggatagtttttcaattataccactaaagccaaagacaaaatctaaccctgtcactctctgtataataccttttattagtcccacgggtttctaaaattcaggctctaaaatgggattttggctcacctctccagccccatttctcttagaccttaccttttacatcctgtgctctcacagtgccaaacttctgatgatgtcctgcatgcttttcatataatcatgccttttcaacatcgtgtgtgtgagtaaaataacagtgtttttgtttattcaaagctttatatatgtgtatgcatggcatagagtcacatgttttagtttgtttattttaggacaaaggtatctatttattttatttatattgtgataagaaaacttagcatgagatctctactcttagcaaacttttaaccttctgatatggtcttgctatgtcccatctaaatctcaccttgaattgtaataatccccacatgtccatggaggggggcaggtggggataattgaatcgtgggggtggtttctcccatactgttctcatggtagtgaattagtagagctgatggttttataaatgggagttccccctgcacaagctctcttgcctgctgccatgtaagacttgactttgctcctccttgccttccaccatgattgtgaggcctcctcagccatgtggaactgtgagtccattaaacctctttttctttataaataaccaagtctcaggtatgtctttattagcatgagaacagactaatacactgtgaaacacagtactatgaaatgtaagtacagccttgtatatcagatctccagaatgtatttacctcatataactgaaactttatagctgttgaacagcaaatcatgtcctccctctacccagcacctagcaaccaccattctatccctgtgcctatgatttggctagtttagatacttcatataagtggaatcatgcagtatttgtccttctatgacttgcttatttcacttagcataatgccctccaggttcatctatgttgtcacatacggcaagacttccttttttattttgaggctgagtaatatggattaaagatttaatgtactaatattaattaaatatctctcacatctactgctgtaagacacctagaagaaatagggggaaagctccatgacattggtctgggcgatgatttttggatataacattaaaagcataaacaacaaaagtaaaaataggccattggaatcacatcaaactacaaggttttgcacagcaaaggcaacaagcagcataatgaagagacagcctacagaatggaagaaaatatttgcataccatatacctgataaatgtaacatccaaattatataaggaactcatataagtcaataccaagaaaacaaataacctgattggaaagggggcaaagaacttgaatcaacatttctccaaagacattcaaatggacaacaagtacatgaaaagattctaaacatcactaatcatcatggaagtgcaaatcaaaaccacagtgagatatcacacactggctaggatagctattattttaaaaacaaaaagataagtgttggtaaggatgtggaaaacttgcacactgttggtggagatgtaaaatggagctatgaaaaaatagtatggagttctctcaaaagattaaaaatagaattaccatgtgacccagcaatctcacttctggatatatacccaaaaaaattgaagttagaatctcaaagagatatctgcattcccatattcattgcaacatgatttacaatagccaagacatcgaagccacctaaatgcccactggtgaatgaatcgataaagaaaatggggtctattcttcaagccattttggatgttgtttccttagatggaaacaccctcgcacccttgtccacccatcagaatcctaccgattcatcctcaaggatcagccaccttctgacctcacatttgcctccttccccactgccgtcacttctttgctttgacacaaccttgtacacatttctacactggtatgtgtgacacagtggttatttaagaatttgttaatgggtctgtgttcttcacagaagagtgaattactataaagcaagagccacattgtattaatctttgtgttcccagctagtatcactgaccctgtactagtgcatggtccatatgcatttgatggatgagtccacatttaacgtgaagccccacagtgacaggaactcacaacattgcaaggtattcacctgatttggaccatgtgccctgtgtcaaacttatattgataaatcttccatccatattgtcgtctctacgtccctaccccatctacccacatatcctacttagaaagaatacatataatccgtcgtaaaatcagctgctgtttgattactagaatgcaaccaacatcacctagcaataactttttctcttttggagaatcctttcaattattctttgtggggcataaagtctgcgtcactcaccactttatctccctgatggagatgaggtgtgggtctgtagctaaactcaagatgtcacatctagaactaaattcaagatgctaaatgggctctgacagcagggtaagccttggccctacacatgatatagtggtattttcccccattcttaggggacaaaatataatatgcttgcattattcctgtattttcctattatagctgtaatggtaaccaactctaatgggttcttaccacttatcaaacactgcagaatcagtggcctgagactagtcttctctctctactctctgaattcaactagttggccattctcctgtcctcccatttatactagaagccctcttggtgagactgcttcaaggttatcagccaggttggtccattcaaatagttgtttttttttttgtctatccctccttagcagtgtccttctgccagcatggcaagaataaaaacccatgagcccatggtactcacagtcacataagccatggatcacagcatccagtccaggcaccagggaagccagaatgtctaccctcaaaaatgtctgctgaattcaccattcacgggtcactgagatctgaggacctgtattccataactccaccagtgtaactataatttcagaagtcctgtgctctgcccgaagtctcagtgttttaaaccactcaaatttatttaatgaaacttataattgctcacatgtattgagtgcactttagataccaggaagtcttcaggcagattcatttttaaattgaggaaactgaggtttagagagattaactaacttggcccagaatattacacttattatttagcaggagaggtaggatgtaaacccagatgtaattgcagagctcagacacctaaattccatactgcactgccttctgaatactttattctcatgctatagtgatagttggagatcctatcagtagtaggcagctggaagccaagaccaaggaaaaccttcaggagcaatagtgaccacctatgggtggcaccatttatgcagggcatggatagggacaaagacaaatggaaaagtggttaccgtcctatagggttctccatgccatgacagcatgctctggttcctcttacaccccccaccataccccgattctccctgttccccaccttactctctgtgtcaattgctattatgtgcagccattatttattctgctttgtcccccttctccccctgttttcctgcacggacctagcacccatctccatgacactctccacctggcccaggcagtctgtgtttatgaaattcatcccttatgtctcagttccaggactgctctgtcttgtccatgaacacctatgagagatattgccaagtgatgtacagggatctggaagcagtctgccaatggtgtacccaggcagaaggcagtgtggatttctcctgggatcagaaacatgtggatgctttagaactggctctagtccagggaaagagaagagccatttccctcagtaggaaaatatccccgaactccatcctctcagcaaaggctagctcaggcccagagtccatcaaaacttcaattttatcaaagtctcctctatagatgccattgtatgtgctattaaacagaacaatgcagctcaccagtaaaatcatttgcaataacagcccattaaaagctttccttaatatggaactttctaattaatgtaaatggggtgcaaagcttggaaagccaagttgattctaatgttcagaaagtaggtaaaataggaaagggtcttatttttcattagcaatgtattatggaatctaatgaaatctttatggcttggatatattacccaaaaaagtcacaattgctttgtttcctgcctcatttctctgccacctttctctataaatatcgctatgttacacattagatttgagaaaatagaattttcttttatacaaaaaaaggcatggagtttgtgtctgaatcgtatcaggttttctgtgttgaaggtagaagggaacacagtaaagatgaacattatttcccagatgtctaagttggaaacagacccaaagagaggtgaagactaatcgggtcatttacatatttctccctccttctcttttcttctcccttcccttcttcccccattttccctccctccttttcttccactcctccttcccttcctttcactcaccctaaaacatatattgagcactgtatctgtcaggttaggctagattacagctcaataacaaattcccaaatctcaaaagttaaacatcaaacatcaaaagcttatctttcacccacactatatgttaaaacatcaaatgtttacttctcacctgtatgacacgtccatcatgggtcaacagggagcagtcacacagggacccgggctgacggagctgccaccaagctgaacgttgctagtcatcatgtcagagggaaaatagaaagcggcaaattgggctttggctcttaaagcacttacctggataaaaacaggtcacttctgctcacgttttgttgtccaatacaagtcatctggccatacctaacttcaaagggctcaaaagtatcaccctacaatgaatctaaaaggcccccaataaggtttgaatctgtgtccccacccaaatctcctgttgaaatgtaatccccaatgctggaggtagggaggtagggcctggtggaaggtgattggatcatgggggcagtttctcatcgtttaacaccacatccccttggtgctgttgtcccgatagtgagttctcgtgagatctggttgtttaaaagtgtgtagcacctccctcccttactcccactcccaccatgtgaaatgtgcctgctcctcctttgccatccaccatgattgtaagtttcctgaggcctccccagaagccgagcagatggcaacatcatgcttcctgtacagcctgcagaactgtgaacaagtaaacctctttctttatcaattacccagttttaggtatttctttatagcagtgcaaaaacggactaacacactaacatacctccatgagccaattaaggtaataatctatgatatcaaaatgaattagaaacacaccctactgtcggggagctcagagtccaatgggagaacaagaacacgctcaagacagcatgataagtgcaatgcaaagctacgctaagagccgtaggaccaagcaggctcattttctttcccctttggcagccctttcctggggcttctctgtttcttgctgtgtgaccatcttccccattccgattggggcccaatgtctgggagggagacacattctctgttccagttctcagacccaaaggcttatgagaaggggaactatctgaaaccaaccaggccaggcaggcctggggctaagggaagtgaggagtgcatggagggaaggcccaggttgttccacatctgaggcaggacagtgagtgtgggctaaacctgatctctgcatagcctaccagtcagtgcctaatgcatctcggtgccagaaagctggccattttaggagacagtgctccagcacatggagaaggtggcagcgtgatttagatcagggatccagtctccacagggagctagagagagtgggataaggaaactgaggcaggatgcagcagagggcaacactgaagttcaaggtttttaaaaatcagcctgcagtagcattctgaccccaaagctatctactgaaatagggcttaggttcttagtggactaccagcctcacacgtttactctataggccttgggcaggattgactatcgaactcatgggagccagagattaaagctttgggagtgaaggagtccttgatttttgtgggcttgctatggatggccagacttcatatccttcacgtccctctgcaacaggccttttgaaagcccatgagaaaatgctctgactgcctttgtaatcactttccaatcagcttcacagaattgtaaaattgattatcctgctgatctcacacaagctttggaggaaagcatgggggcactttaattctttgttgagttctgcacactgattcaaggagactttagcttttccattcatgcccaagaagaaggaagttcaaattaccttgaaattacaatttaggggcatcaagcctcggccagtctgtttcattttcccaatcacccggccagggccaaggccgagaaaggaggtacctggcatataactcctttgtaggaatgtggagaaggggtggagctggagaccgagctcctgctgccctccacaggctcaggtgcctctaggaaaagtaagagtgagaggctctgggaagcatgcactggatgcctcaaatttgagtctggttgttctagggtctccccatgagatgatgattagggtgtcatagttataccaaggcactcccactcatttttctttgttttcctcttctgttgtgattaaacagttgggatttctctattgctgcagggaaatgaatagaactttgtcatgcatttcaccagcctagagattcagggaaatcttcctgcaataaaggggcttgacccgggacttgagtaatgaccaggtgttggccagttgtagaaaattggaagttcatcacagacagaggtgacagcatatgccaaggcacagaggcactttgtggagcaagactgagggagggagtggtaggcataagactggggaggctgggcacgccagagttgagcacctgaaggcagaagcaaaggcttacatgttcaaaacgaaatgcagcattccaagtgcaaaaatggagctgtgggggcacggtagaagcaccaagtggggaatggttgccttggagacttgctggagcaagttgagtcagtgtcacacctgtcaaattacacatggaattcacaaggaatttcttttttctctaaatgaggctgataagtattgaatgcttactacatgtcagaactattttaacagctttgcatgaattatttaatcatttcaaaatcctgtgaaggggataccattagtatctgcgctctacagatgaggaaactgagcctcaggaagttaaataatttgcaggtcataaaactggtaactggaggaatcaatattcaaatataggcagtctgaacctagagcccgtatcttaaccgtggcacaatgctgcctccagtgatcttaagaaaatagagcttgttcattcctttgttcattcgacagatactcactgagatatgcctcaggttttgtgccaagttttgggattacagggttgtgcaagatggcaacttagattcccacattggagaactcggtctagtggggagacagaaaatgagtgaacaattaaccaaaaaagatactatcaggttgcaaaggaagagtaaaatagggcatcaggagagaaaacacaggaactggaaagcatctttggtgccacacagcccaaatcctgacttttcgagatgaaagaattgaagccaagaagagaggtgtgatctcagaatcatacagtcagtaggtatctgagaacagaaaaagaatcaaagactcctaatatatttaagagatgtttatctggtgcctcccgctgtcctaggcaccaggaatgcaatgctgagcaagaccatcacggtccctctccttggggatcttacattctttcccctactctgtgggggttgctgtgctgttttcaatacacacttcatttcatcaaatgtcggtttggctccagaatctgaattctcaaccagtgagatgtaccgcatctgttaagccttctattctgccccaacctctgcctctgaaataatcagtcctcctctgggtaggacccctagtactatttctgcactattagttataatgatgctatttttactactgctactctattggtgctgctgctgtattcagaatactatcatccaggttcttcctatagtgttatttttgtgaatcacagcactaatgctaccacttcactctggcttcatctttctcttccttcacttttcttttctgtcctccaaagccatgtcttccacaggcaatttacagaggtggcgaactgaggctcagcgctaggaaatgtctcctccacagtcacaaggctcacaaccggaagcacaggattttaggttgaggtcgtttgttaggttgaggttttaggttgaggtcagtggtactttgaaattgagacaaagagcttgcagctgaaagtctattggtgtttagaacctcgttacaccatgtaggatccaccaattaacaacagcatcagaatctcctgggaatgtgtttgaaatgcagaatctcaggccccagcccaatctactgaatcagagttcagtttggtcgtaagttaaagcttgcaaaacactggtttatgcatgcatacatttgtgttgggggagtgcaatcaggggcaatgaccggtgtttgcccagagggaccaccacgttttgggcatctttaccttctaggaataaaccacttgttggaggagcattagacttgaggatttctggagttagcatgtaccctgagctcaggggtccacttgggctcacaggcagatctcccttgcttttctctcttctgtgggcaactccacccagtgcctgacttctattgcccctgaatgtttctgcaaaggttcttcaagcacaggtgaaatgcatcgctttgctgagaaggaaacagagtggtgaaaatggcatttatccaagttatcaaaggacggaggtaattgcaatatgaaccaaaagacacgcatctgacagccttgctccctctctttctatgtagcttctctttacacgatccaaactatcacccgtgtgtgctttctttaaaaggggaaatatgataacgtcagtctctggtttaattccacagctggcatcccacagttttgtgaagcttgacttccttatcgcgcctttcaagaccctttgcaatctgaccccaattcactactcttgctcatctcccccactatagactcgatcacccagaatttgtcaccattttttcgtactccccaggcttttgtggctggggatctttccttgagctgctccttctgtctggaattctttgcctcaatctgcttaggagcttcttactcccatttcatgtcatgaacactgctgatatccgcccaacacccaagtctgagcttttcaccattgtacctcctgaatcttccctttcagaaggggccatggaaagggtgaggttcttggggtgagggttagggtctggctgtgaacttctccccagagagcctgttatgctgtggtcaggagccctgtggcatttcttttccagaaaggcaactggactgtctggtcacaggaatggaacagaagacatgtctccgcaatggagccattgatcactgtcatagagtgcaaccagctgtggcctggagagggaacatgctttggagaagttctctcagggagagtattccttaatatgagactcttgagagtgtggtgagggtcagccagtgtgagaagattctttcccgatgacatttctgagacagttttgtactgaatcaactgtagaatgtctctcctttctgctgtgggaacataggattgctatttctcccctgcagggtggagcgtttccatctttcatccggcaagctcgtatctttttagtcccgttcatcacagttttctcacgtaattggggatgcaattttccccatccactgtgatcatttgctgttggcaaaattcagcctttggattctggaactattttaatttgtagagcttccacatttttttcccaaagaattttgctatctttatatcctcccatgctgctttattggttatggtggttgtttgtttgtttaattctgattgcttgtattctgatagcaatgttgaacactaatgttctgagcaggcacccccttctttgttttttgctttaatgggactgtcctgactttcactactaaaaatgaaattgactgtcaatcattctataagccttcaccctgcttttcttcatagcatctatcattcacttccttttatgtttaaataaagaaaatctgcctatctatccatccatctatctatatctcatttatttatcggtttacttggttaccacctctcttagttcctttgttctgttataacagaataccatggactgggtaattaataaagaacagaaatatatttctcaaacttctaggaggctgggaagcccggatccaggggggcaggtttggtgtctggtgagggcctagtcccttcttccaagaggacactttgaatgccatgtcctcatatggcagaaggctgaagggcaaaaaagggcctaagctagttccctgtagccttttacgatggcaaaaccatcctggtttaatcacttccccagaggcctcacctcctagagccaccacaatgggaattaagtttgaacatgaattcagtagggttcaaatttacaccgtggcaccccttgtctttcctagtagaatgtaacctctctgagggcagagactgtgtctcactcttccttgtatccttgccacctgatgggcagtcagtaaaggattgttggatataacacagacatgactgtccccttccattaagaaagactttccctgtccccccgacacacacaccccaattacaaatacattactttttctttagaaattgatattgaattttgtcaaatacattttggagtctttgggattaacttcgagctatggctaaaggtaattactttggtcgaatgttaattacaataatcctggtggaatttctggaatagattcttatttgtaatagtatattattcttttaaagttgatatgctggtctataattttgtttttggttattggttttgttttgctgtgattctgctctctgtgtcagattctagttgttactaacttcttgtaagaagcttccagccatgagattaaccccaaaagatatataaaaccccatcagcaatgcatgaaactctcactccagcaacactctgtattatcattttaaattatctttactgtttagaaaagcaaacctagatatctaatataaacttgcaagtatttgatttctggtgaggtggaatctcttttccccccattggtaatatgtatcttggtgaatttcctgttcatgtcatttatcattgtttttctatttgcatgttcttcttttttattgatttgtaagagctttttcatatttgaaaatattgactttctctgccatatatgtttatgtatttttcattttgttgtttccctttaatattatttgattgtaagttttaacattattaccgtatgatttttaaactctatcactgggtttattaaggtacattttcttcatttacttgcgtgtttaaaaagtccagaccagagatcaaacaactagccacagctatttacttctaataaatgtgtggctttatttattttacgtttgacacttgatttaatgaggtttccccttgtccacagaccacacctgaccttttccttgaacctcagagggcagcagaccctgcctctgaaaagttcttgagaagaaagagctggtgttgagagtgagacagatgggctatggcagtgatgctctctgctcagggaaactgccacatttccctgcagctggcagacgctgaaacacactgaggtcattgcttttttatttagatgttaggggttagaggtgctgacttgcacctgttctgcctcctagactgtcacttgccctctctgctcccacctccctggagcccccagttcccaaacagggtgacagaccccaccccagcaccctctggcctcagctcaggttctccgcctggttcctgcatgactcatgctgtgaggtgcttcattggcatctttgacctgtggttcctgatgcaggtcttactggtgacccattctgggattcatgaactgtagggtggtacagggcaaggagagctggacttggactcaaacagtgtgcatgtgaaatctgacctttcattctctggttttggtatatccacagctttcctctcctccctgcacatggtgtcacaccgttctgcatgctacacagaattgtggtcagggtcaagtcattgcgaatgagacgcctctatatgtatgtccataatctctattattacaactgcgaattcatattggtatcaacaggttcatttatagtctgaggttgctgctgctggccactgctagcatcaaaggctgttagatgcatccatgcgggagacaggtcatttggggatgtgacaatcaaaaaggagtggattctgttccctctgagagttcttgtcaatgataggatcctgtcagtttacaaataaaaaatctaaatatttagaaagcacaagcttctgcctgaaaataaggattaaaaatgaatatttatgaactgatagttctgcaactctgtcctcaaaatgcttcctttggtgacacttacaaggctgtcactctttgaacagaagccagagcccagcctggcagcataccattagttccatgaccttgactaagtcactcaccctctctgagcctgtctcctcagcagtaaagttggaagggtggtacttcactcctggtgttactctgcaaagtaaataacgcaatgtatactgcagagcctagtgaaatgctaggcacacagtaggtactcagcaaaatgtgcgtgtcctccataggccctatttcactgagatccctgtcatttcttcctgcctaggatgtggcagaagcctctgtgttttgttatattttagttagacattgttttagtccattcaggtggctgtaacaaaataccacacacaggataacttataaagaacagaaattttttcttgcagttctggaggctgggaggtccaagattaaattgccagcaagttaggtgtctggggtgggttctctttctcgtagatggcaaacttcatgctgcatcctcacatggtgaaaaaggaaaggtgtctctctggggtctcttttataagggcgctaatccttttcctgacagttctgccctcccaaaggtcccaccttttaatattatctttttcagagttaggtttcaacgtatgaatttggggggacattcaaactttagcaaatatcctctaaattgaattaaaaaccctttatcagaatcgggaaaaccctggcttggcatagtggctcacgcctgtaatcccagcactttgggaggctgaggtgggtggaccacttgaggccagaagttcaagaccagcctggccaacatggtgaaactgcatctctactgaaaatatacaaatttagctaggcatggtggtgcatgcctatagtcccagctacttaggaggccgagacaggagaatcgcttgaacccaggaggcagaggttgcaatgagccaagattgtgccactgccctccagccttggtgacagagcaaaactccatctcaaaaaaaaaaaaaaaaaaaagagttaagaaaaccctgtcttctgtttaacagtcactctccagtccagaacccctattttctgaccaactgtcttgctcctctgtctttaattgtctcccttcacttggaaacatagccaagggctgatggatcttctcatctttgaaggttggactcttcatgcttttattacatcttggatattagggaagtaaggaatgtttggagtctcttgatacagggtgactccactctccccccagtacccaaaatagcctgaagactagctgcataaacatcctaggagtagagaagtcttgctaaaactgctgatgtcctgactacattctggaccaacctacatgtagactcagccccaaccacctgccatatgatccctctaaggtgaccccagtcttactccctagttcaactggacaggggtagaaagactacaatttagcagctcacctggacacaactgataatgcccccttgatgaaaggactgattctgaaattaccagccagtgtagttgaggttcttaacatttcttcccttgaaccagggactgggctcaaatatatgatatagtggtagaatttcaggcactgggcttggcaatttggggctggagaacagccctgggcactgaaactggagcttatttattcatgcaacaaatatctattgaggatctactctttgttttaggtgctaaggatactacaatcaccagagccaacatggcccttttgtgtgtgttgcttagagtcttgtctgagtggaaaatattaatcagataaacagataaatgtgaaattgcatgagtaatatttgcttcagaagtagctgcaggagagggcttgaagtagagtgtcagttgctttttcttagtgtgttctctgtaagtggtgctttggcagcagatgttaagatgatagtgggaagatggtagaagaagcaatgtgagacataagaccaaataatcagtgctttgactctgagtcacaaagaaaatgttggcacaggatggtgccttttggatgtccttattccttcaccgaccagtggtacagatcctggccccatggtcaggttttacctctggctgaaaccactgccctatggggctgctgttctgtaccactccagaggtcaccatccccattgttatagtgtgaacaatgctcctgcaagttgtgcaaaatcatggttcttgtcctttaaaagccattgtggcacattggacttgagcagggaaggtttgcccaagtaaataacaatagagctcagaactgaaggaagaggtgttaaccaaaccaagagagggtggaaaatcatgctgtagtgagggaacagcatggccagaacctctggtgaaagatgtagggccagtacctggggtagggaggaggcaaatgtggtttgagtgcaaaatcagtgagatgatgtgggagtaacagcaaccagggcaagaccatgtgtgatcttcaggccacagtatagatggttgcttttatcctaagaccaatggaaaactattgaagaactttaatgtcttaacagtaaggatagattgtgtttatccagtgcttattatgtccaggcactgttataggggctttacaagtattatctcagttattccccattctgacctataagaaagggacatcattgtctccatttaacagaagagaaaatcagggtaccaagatgctaagcaccttgcccaaagtctcaaagctagtaagtggcttacattgttaatcactgaagacagttgcctcctgcttttgacaagaagtgagtaagggctcctaccgttcttgagtgtagcaaggaaaaacgtagcccgtcctctgatgaaaaggcccacccctctgccagggacatgtccaggcagggcagcatggtatacctgagagtttgtgtagctcaaggggaaggcttgacacctggcacaggtactgactcctgtcgctggccgttatctggagctggtgcctgaggattccgacaaggcagagaagcccttatcagcccacacagctgcttcctgggctgtttcccccagggagttacatggcagtgaaatgaaggcattgacattcagttccacttcttggacaagctgtgctgccttggggagcaccagatacccatatgagttagtgtggtttggagtctgcactttggatgaatccatggctcataacacacgggttacaggatttgggatgggtaagcatggacctggacacagagagaggaggggacatgaaggcagctactgagctaggggagccagcatctcttggcattttgctgaggaaagagcaaggaaaagattgaagatccagatgaggtgttcacttaggtgagatgttctcatcagggaaatatactttctgaaaacacaacatccctcaaaatagctcaaattgccttacagaaaatcttgagcaggggatgaaaaatgatttggcatcatggacatacaattggaaacccgatacccaggcttctcttccttttctgttccccattgtctctgcttcttgcttccttaagtgtgtctgccccatcctcctttctgcacgctggcttttctctttgtttgggtgttgattttctcccctgtcacccacttcaaaggatgtgttcttcagcctgcaatgggactaactctggcccccactatctctgggcctttgagctctggcacctttcatttttattttgtggcttaatatattcagccctcttagcaattgaatatgttcccacagcaccattgactctataacagcaatggtggttcaggagctgggagaagtagcctgcgaagcataggttcagggtagagagggtattaaaattctccagatgcacccagatttggagacaggtagtgcgttccttctcttacagtctcatttgttggagtgctctcacggttcatgagttatttattctttggaggcaaaatctgggcccctagaatgtttgtcattaaatgaaagagccaagccagacgtggtggcacacatgactgtagtcccaattactctggagactgaggtgggaggattgcttgagcccaggagttcagatccagtctgggcaacacagtgagaaagggaggatggatggatggatggattgatggacggacggatggatggaaggaaggagggaaggaaggaaggagggaaggagagaaagaagggaggaaggaaggagggaaggggagaaagaagggaggaaggaaggggaaaaggtaaaggaaaggaaggaaggaaaggaaagggaagaaaaaaaagaaccagactcaggactcctccacccctcacacacaggctaggcagcccaaggcagtatggttgagacactgtataaccccctctgaggctaacagtgaacccagtgagacagcgataaggcaagaagccagtatgagcaggtctccatgggagcgtttctatatttatattcagagcacttcaaagaatatttcaattgctattactttagcaaaagtctttcatgcaaattttgatatttttcaatgaaggaggcttcatccaaatcaatgcaatgattctttccacctcctacatgaaacacccagcaccttttagttacacaccttcaacatgccaaggagagagtctctgagttgctttcctcacatttgggggatttgtgaactctgaatcttaataagagcctagagttctaggtgtaaaccttgtaaagagtttgtgtgactttaaatattgccccagcgggttaccttgtctctgaaagcctgctacgctcccagccatacttgaagggcaatgggtttcaagatctcggggtccctgggatgctaaagctggagggtacatctgctaaagctcagggaactcccattttcggagagcactgcttacaataacctttgatgtcttcaagtcaaggtccacactcctgagatttagcttgggatggccatgctgggtacgcagtggtcatcttctcagatgcctcctcaataccctgaatttgtgttcatttttcctgcccagggcataatctatgtccttgttcttccccacactcacccagaaggagcccctgaaggaagcctcctgggaggttgttgagtcaggcagctgaaccagaaggaaaggtctagaaactgggctgtgcagcatcccctgggcccaggaagcatggaggtgggactcctgcaccaacttgtcctctcaggtccgcagcacccagagcctgggtagaagagcctcaggagatcaggggtccctgcatcctgcatctatggtctgagttggagctgttacctttcaggatgaagagttcagtcctgcaaccagttctcaccatgaagtctgtctcagcctggctctcacaatttgtagcagcccccatgccacccaggctagatgcctaaatctttcaaagactcacagagatctgtgtgacccacacacacccctttcaccccatctcccactctcctctcctggaaagctcttctcttgggtatccacttagctaattccctcacctccatgacgtccttgctgaaatctcactttctcagtgaggctgatcagtctcacccctgcatcacctgctcatgcacacctatcctccccaccctgctctgctgtctccttccttttcttttgttttctagagaacttatcatctactaacataccaaataaatggcatatttattacattcattatatttttctcccctcctctcaccttcctagtaactagaaggtaaactctaggaaggcagtgtcttcactggtttgttcctgggcatatctcaggtgcctaaaataacagctactgatactgcccaagagatagttattgactccacatgaatgagtctgtggtttccccaaaaataccatcaaacaccctctctgatgttgtagattcaggtctgactgacctactcgacagtctcccaagtgctaggaattttcaagctctcttatacacatggacacatttcaacttcatgaaaaacctttcttcttgatgatggaatcgaatattattgaaggtcacccaggtgctaagcatcacagcctaaaaccagcccagcacacccaagatcaagttcacattgttaatcaggttcacactgtcttttataatcccaaagtatttccttttattctccatgaatatttactgatataattcaaaacaactccttcctattatgaaccccttcccaaataaaatgcgggagaaggattacatctataaagaaacacaatccaagaagtacattttaagggaaaaaaaggcaacgtctcaaagccactttcttttctggtttttagtttgacttttccctccaatgggtgcctaatgaggcgtgactgcagaaggctgggcaatcaggctgctcacttcgtgggttttactctgcaatccccagcttaggacaccaagtttatagccttcgcaatcagcttcgctcacatgtgccgtgtagccactagaatcacaagaggggcagagagaaaaggcagtcttctatgactccagtgctcatgttcttacagcactgcccactggcagaatcacaggtgagtaagagggactgagttccttgtctccaaagtgttccagatgattccttgatggcccctggcattgcttgtaggggcatgtctcactcagatgggacagaagaagaacgggacagaagaagaactggacagagagggcagagtggtcaatgacaaggtagagcttcttgggagccacaggtgcagaaatggaccctactggccagtgggaagccacgagatgggaagggaagcaagtgccagaatctctcagaagctgagggagaaaaccacttagcacacagttagcaacctcccaagtctggggtagactggggcaggggtctgggaggagttggaaaatggagcatgtgtctctgcacagataacaagcctgggcaccacccatctgccaatgggcactcaggggagggaagagaggcttggtttgggtgtcaggggacctgggctaccctcaagggtggcctctggaccttcagcattaattaggtgtccactaagagagagaaggcattgaagaaggtggtccacaaggccctgctgccctgggctgagttgtggccaggctgaaggacagagcccctggttaccctgtgagggctttgggaagtcccctcgagcaggagggaagtcatgggcagagagcacgtcttcctggcaactggctgcaggtgaggagggggacctgactcctggcactcagtgtggaagggaatgtgttggaaacagcaatgcaactccaatattagcattggtgccacactcagcaccactggatgctttcccacaagaactgcctcatttagtccacacactcatccttattttacagataaggacctgaggctcagggccgttactgcttgctctagacgaagcttgtccaaccctgagcccacaggctacatgcgacccaaaacggctttgaatacagcccaacaaaaatttataaactttcttaaaacattatgagattttttcatgattttaattttttttttgtctcatcagctatcgtcagtgtgagtgtatttcatgtgttgcccaagacaattcttcttcttccaatgtggcccggggaatccaaaagaccggacacccctgctctagatcatgcatgcttaataggggtgccatcgaccccaagagatgaaaattggttcttggtggtagtggtgggggtagggtggggaaaaatcccttttcatacacatatgcataatacgcataaagcccacatacagccatgcaggtatgcatagcgtccatatacagctatacaccacatctgtagagttaaaattcataggggtacaacacagaaagtctaaatacatttcttaggaggtgatagtaaagaaaaaaatgattgagaaaccctggtctagctactagctacaagtggctattaaacactcaaaatgtggctagccggaatagaaatgttcagaatataaaatacacaacaggtttcgaacacttagtgggaaaagagaatgtaaaatatcctcaataattttgtgttgaatacatgttggaataatagcattgtggataccttgggttaaagaaagtatattactgaaattaattcccacctgcttctctttgccttttttccccatgtggctcctagaaaatataaaatcacaaatgtggctcacatcctatttctaatgggcagtgcagctataaatgaccatctgctaagaggaagcatcaggatttgtacccaaggtttctgactcctttgttatcccatcgctgcctccttcgagtagaaccagttactgtggggccttaggtgtgcttcctaacctctctgagcctcagtttcctcctgctcccatctcctttcagcactctgtaaatggagtagttccttccagctgtgaggttccactctggacccagctatgagcctggggtcactgcagaataggagaacgtagagtccccagatgacccatttcatcagaaatgacagttccataaacagcagtgtcacctgctgtgtgtctgcttctggggaaataccacagaggcaaagttagaaaaaggaagcttctaacctgaggccagagggttggagaaaaggttagtataaatgatcgttttaaccaagaagggagaaaaaaaaatgttcatctcttctagtaagaaggagatataacaaaaaaaaataggctttacaaaaccttctcatagtaagtaggggcgaatacaatttcttacaaatgctactctgctggattgaattgatggtgtagtctccaacatgccctccctttcgttcctttcctaatgcctaatttagtgggggagaaaatcaattctattttaatttcatgagaaaaatgctgaatgaaagaaaagtgcaatagagtgaaacttcagccttcagccccgcactggcccagaatgtgtgattacgtgatcgatggatttctccttagaagggcctctcaacctgatccctgacttggcctctgacaatgatgcaggaagttcccaggtggtcagaaaacccctctggggtgcttggaaatgcattctagcatcaagtcccctgatcgcccctaattctccagatttatttccaccccatttcaccttaattttggcctctgtgcccccaacgatgcactcaaaagctctctctgcctgtccaaatactcctaacatgtctttgcactctagctgatcctttaagagatttccagcaaaagtttttggtctcccaggccctggaagtaagactggccactcttcatgatgacaaaagagctccaaggttaagcaggtggattctagattcatactgccggggttccaagcctgcctctgcctcttcctatctgtgaagacactgggaagttgctccccttaagtctcagttttctcatccgcaaagtgggaatagtaacggtagtagcctcataaacttgtgggatgattaaacgagtaatgtgtggaaagtgcttggcaaggcacctggcaactagtgagtggtattaaatgtcctctcgtgttgttaatattattgtaataggccgggcacggtgactcatggctgtaatcctagcactttgggaggccgaggcgggctgatcacctgaggtcaggagtttgaaaccagcctgaccaacatggagaaaccccgtctctactaaaaatacaaaattagccaggggtggaggtgcatgcctgtaatcccacttactcgggaggctgaggcaggagaattgcttgtacccgggaggcggaggttgcggtgagccaagatcacaccactgcactccagcctgagcgacaacagcgaaaactccatctcaaaaaaaaaaaaaaaaaaaaaaaaaatatatatatatatatatatatatatatataattgtaataaattgctgcaagaatgtgaggggtggaggggtgtgcctttggcttctaacttgtgggtccatgattacagatttgccaatcaatgagacttagtgcacattttttgttcttttttttaaaaaaaatatttagttcttttttttttttttttttttttctgaaatggagtcttgctctgtcgcccaggctggagtgcagtggtgtgatctcagctcactgcagtctctgcctcctgcattcaagtgattctcctgcctcagcctcaagtagctaggattacccgcgcccgccaccatgcttagctaacttttgtatttttattggagacggggtttcaccatgttgaccaggctggtctcgaactcctgaccccagatgatccgtcccccttggcctcccaaagtgctaggattacaggcgtgagccaccgcgcctggctcaatatttaattttaaaataattttagacttacagaaaagttgcaagattagtatggagtttctatatacccatcacctggcttccccttatgttagcatcttgtataaccacaggatagtgactgaaaccaggaaattaacattgatagatactttaagctacattataatgaacactataatctacaggccttatttgaatttcacttatcttcccactaatgtcgttttccagtccaggatcctatccgtgtttcacttacttgtcattttttccttagtctcctccagtctgggacatctcctcagcctttcagtctttattatttttttaatattttatgaccttgacacttctgaagaatactggtcagttattttgtagactgtcctttaagttagtttttttttttctttctgatgttttctcacgattagatcgagattatgcatttttggcaaaaaataccacacataaccctttctcagagcatcgtatcaagaggcatatgatgtacatatttatttttatttttattttttacttttgttttttagagacagggtctcactctgtcaccgaagctggagtgcagtggaccagtcttgcctaaccgcagcctcgacctccctggctcacgcaatcctcccggcctcagcctcccgagtagctgggactacaggcatgcaccaccacgcctggctattttttaaaaaaaattttttgtggagatggagtctggctatgatgcccagcctgaatgtccatatttctcattactggtattgttgacattcatcatttggctaagaatgtagcatgtatttgttaagcatttactgtttccttttggggatatgaaagagaataaaatattgccgatgctctttaagaaactcttgtctaatgaacaaatggtgttctagttactactgctggtaacaaatcactccaaaatttagtggaataaaacaacaactttattatgcttacatattctgtgggtcaggaatgcaagagggcagggatgatttgcttcagctccacaatgtctagggtcccagctgagaagactcaaatgaccaggggtgaccagagagccgagaactggactcacacggcagcctcctcacttagctgtctgttgcccagatgactggactcagctggggctgtcaatctagagcatctacacagggactgtcatgcaccctgcgtttgctcacacatggcggccccaggggagttagacttcttatacagcagcttagacactgtagacataagagtctctgtggacaagtcagaaactacattgccttcatgacctaatcttagaagtcacaaaatatcacatcccctacattgtatcggtgagagcagtcccaagtcccctaagacttaaggggagtcaggggatataaacaccaccttttaatgaaagcagtgtcaaaggatatgggctattttctaaaaagcaccaaaaggactttctacttacacaggtttagaaattcaggcccagatacaagaccttcaccaccttgggcctccttaattattaaatacatagttactgagcaccaactctgtgccggacaggcatggacccagcttctgggcttgcttggcaagtccctcctgagtggggtgggctcagacagaccctctacaaagcctcgtgttctgacagttgcagcctcccctcaatcagcccctctccctagaaactgttcacacaggatgtgcacagaggagccaaggccaaggtggcagggtggggcggagaatactggacttcaggatcagaatgacctcattttaaatcccagttgtaccacattgaggatttgttacattttcattcttaatcctcatgtatttggtaaaccttattgactccttctctatgccaagctgggtgcttggcaattattacaatcaataaatagaatctaggctttgcccttaatgaaggatttgttccaggcggtgtctgccagaaaggctgttagtatggctgcagggttccaatgagcaggatcatgggattatttaacttcttgcatctccatgcccaaagccaactggagaggaattggtcatgcaacttagcaacttaaccaggttaaacttagcagaacagaaatcagctgagtgtgaagttggaaggcaagcagctcacgttcagaaacccaagaagtattgcaatacagactaaaagccattgggaatattgctagacagactcattaaacaagaaggtttctgtgaaaataacaaaatcatagcacccaggacaccccagcatgagactaaaagctgaaaggaggttgaggcttcatattattaggctgcattatggtagttcaggaagaaagagcttagagccgtctgagttgatggtggccctgctatgggactctgactgcattctttgaaatttagggcagctgggaagagtgaatctcagaatatccctctcatgtgaggcaggggagggaaggcaatgagtctgggaagcagcccggtgctaaggattggaggggccagaggtgttggtggagggagcacctgttgacaggaatacactcacctaaagtgtgtctggtagctaaggagcaggatggtgacacagggaagagagccatatgcatggtaggcacataatgtttgttcctgttattatcacccactaactaaccctccattttggttgatggatggtgaatactaaggaccctgggccagctggatttcgagtttgttttctccctatgtttgatcccacagccaataggaaaacagctgaagtcagagagcagggcattgattggaaatcagcaaaagccatgttgggcaaacgagttaacttccccactcctacaacagccctttgatccatggtaaccaagaaagtccgcaccaggctagaggaagcccctgcagggccgcagcagggctgatacggccaggaaccacgggcatgggtccctgtgctggcagtgctggggaaggtgtgcagcccgggcaggccccggcacagccaaccaagcctgcaggctgagcctctgaccctgaagcttggctttggaaagcagggaagcctggcagatgctgttcagaggcgttgctgctctgttctgttgtctccagggcccttcggctggtgagggtacaaaatagagcttcagtcgcttaaagcttggtaagtgatgggtcagagtttcagccctggctctgcaagactgtcagccagtggtcttccctcccgctggctgagacccacactctttgccttcatgaatgttaacagcattggaagcacgaggccagtaaggatacttgcaggtcttccccagtggttttcagccttaggaggctcaggtctggggccatgtgttggctccgtctcattcttacatttctagggacctcattcttctccagccaggactcagaatctctcagagtcactgttgtcacttctccatctcctctgcttctggttgaaacaaggccttctttgtatttgtcatctgcatgagagccagaccctccaaagggaccccggtgttgttcctctggtcatttcaatcctccatccccttgcctgagaaagtgtttctccaaactcagtgtgcatgagaatcacctggagagcttatgaaacaacagagtgctgggcctcagccccggacattctgatcaggaggtctgggatagactcatgaatctgcagctctaacaagctcccaggtggtgctgatgctgtttatctgcaaaccacacgtttagtagcactgtggtatgatcctgtgtctctcttgatggcctaccctctcctttaatggctctatattaccctcgaaataaaatatatacacttgagtagttcattaaaggcttccataatctgagctcagcaggaatgccacctactgttgcttagtttgtgcactgcacaaagacacactaccaaggaaatgaaatccattaaactctgtgctgtgtctgccaggaagaatatgactgggcaccaagaaaagcgtatcttcttcttctcacaaaggcagcatcagctcactgaagtacagggggctgagactgagttgagacaggcaccttttctactttgcacaaaagcatcccttaggcaagcagttgtcctgcccaagagccttttcttctttcattctccaccatctcctgtcatgcctcccacccttctcccatgctcctcatctggttaacagcttcacactctatgaggaaggcatctggccccagagactcaatctgttttctctgttacatgctcataagagccatcttcccttccttcagaacagagctcttaatgtgccttgcccgcttattcctgtgggccatacctatctccctcaccaaattgtaggttcctgaggattctctagagcttagtacatggccaagcacctagtcaagagctcaatggatatctgtttaggttctgttctgcagccacaaagatgctcacagcagccaaatctcagcatgccatttgttgtcttttaaacaattgattttgaaataagtttacagagaaactgtaaaaaaaaaaaaagagagagttttatacccctcatacaactttccctaatgttaacatcttgcatagccatggtatatttattaaaattaagaattcacttcagtgcattattattgattaaatgccagacttttttttttttccagatttctccaggttttccacagaggtcttcttttttcttctaggctctcacatagcatttcgttgtcatgtctccttgttcctcaacctgtgaccatttcttggtctttctttgcttttctatgaccttcaaacttttttgttttgtttgtttgtttgcttgcttgctttgagacatggtctcactctgtttcccaggctagaatgctgtgctgcgattgtggctcactgcagcctcgacctccagggctcaagtgatcctcctgcctcagcctcccaagtaactaggactacaggcgtgcatcaccatgcccagctagttttttaaaacaaattggtgtagagatggggtctcgctgttttgcccaggctgctcttaaactcctaggctcaaataatcctcctgccttagcctcccaaagtgctgggatttcagacatgagccactgcgccttgatacagaagccaaagccactcatggacattctggagccttccttccaaaacaatggcttgtcttccaggagtaaagaaatgggggtcactctgcaacataaaatggaaactaaaattagaattataatttttcccttgaagaactcgaggctcagagaggttaagcaatccctcaagctacacagctaatttaattattcatttagacatgcaaaaggatgaaatgttgaacaaacaccagatacgatctttgcctccttggagcttaaagtctagtacagaggtctgcaaactttttctatgaaaggccagaaaataaatattttaggcagcgtgggctgtagggtatctgttgctacttctctctgctttcgtagtgtgagagtagccataagtccatatttaaatcaatggtgtagctgttttccaataaaactttacttacaaaaacagatggtagattgaatttgacttgcaagtcatattttttcagctcctgggctggtagaaaagggacttattgatgaaataattacatggttacatggaaagttagtggctcaaaagagagacaggtgactctggaaacgtaaaataagaacctgggagtcagagaagatacccataaaaagagtccctgtaagtgaggtccgctaagggtgaggagtcatgaatgaggcaacaaggaggcatgggaaggaagacggggcccaggctgacagaagagctggtgcaagttcctgtggcagaaaagaccatggctctttttagtactgaagtaaggcttggggtgctggggggaggacgagcgaggccagctcacgcactgagctgattaagaccacatgacagagacacattcttcatcctgagagctctgggaaagcattgctcttacgacatgattggattttgtcattgttgttgttgttgagagggagtttcactcttgttgaccaggttggagtgcagtagcgccatctctgctcactgctacctccacctcccaggttcaagtgattctcctgcctcagcctcccgagtagctggggttacaggcatgcaccaccacacctggataattttttgtaattttaatagagacggggtttctctgtgttggtcaggctggtctcgaactcccgacctcaggtgatccacctgcctcagcctcccagagtgctgggattacaggtgcgagccactgtgctcagcctgggatttttgttatgaagcacctgctttggtttctggctgtggatcctactgtcagcaactaaaagagaagggggacatccttgagtactttttgcagccagaacccatgccaggagcccagggttgatgtgcagctgtgtacccttccccctactaaccctttattttatgtttgctattctacaaatcttccgttttccccgcttataaatgaaggttcatattatattatacgtttacagccacagctccctcccatcccatttttctcacctttcttctttccctccccagcccgatccctcactaacttcgtgaaacttgcaagttaaatttttcaaagactgtttctgacaaagcagtgggaattagatttggtgaagcccttcataaaaaattgaagacatgctatattaacatacattgatttattcatagtgtttcattacaagtaagtgaggatcctgtaataccaggaaaggttaggagagcagaagagcgcggtatattatattgacagctcggtggaaattgagttgcttttggattgaatttggagcgcaggaaaggaattggctagtaaataaggcatgagttttacctcccagtgtctgtatatcaatgtagttgccaccagtccaagcagggggacggggacagaattttcaaagaatgcaagcacacgtcctctccactggtgcactggggttggtggctacaggctgaactgtctgtacatctccccttttctgccacagtggaaaccagaatccacctgcatgctgaaaactccatttgcccccatttgctcactgctctgcagtggctctgggctttgctctgtccaaaccttttcccatcccagatctttgcctacgcggttccctctgcctagaagctagaatactctttcctcttctgactcaggattgtccttcggatgtcagttgcactctctcctgagatacctccacgagcatttttccttagtttggtcattctcagatgcagaccctgagatggggatttgaatatgagcagtttgccaagaagtttaagaaacaccagtaaagagatatggagtggggaagagaaaggaaagtagccaatcatcactgtgttttcaaaccagctgcctctagaggcaagtggagctgagcctctcagggaaattgggatgctgcaggaataccaaggagggggagcttgcaggggtataaggaaggggagcctggagaatgtatgcatcaactcccatcagggctggggtgttaattaacccccattcccagcaagcacccatggagaaagtcctcaaacagagaggcagatagatgcctgtagcacttgcctctgagaaggagtggggtgggtaggggtgaccagagggaatgctgtagacaggtccaccagagcagcctgaagctagcagccacctgcatggtgcacatgcacactcaggtgctgcttgaaaaaaagcccaaagccctcagctccctgcatttttcctccctcctgcgcacactctgctctgggcaccgtctgacctctctcctcaaggatgcggcaccactactgtttaatataggacagagaaatcacttttctctccaaaacacttggtgccattgccagtaacagcaaattgcttatttttgaagggaagttggtgtgcttccttttctgcctgggtttggccattcttgatggaagataagtgatgtcagctgtgtatatagctggcttacctctctcaagaatggaagtcacttgaggatgaggcctgacttgaattcagttgggcacctctccagcagcacacagtgcagggcctagaacacaggagtacacaggaaacactgtgaaggagcaaataagtggatgagtgaattcatttttcaactgatgcactgttaacaggccaggcaatgtggtatagaatatagagtacaggctttggagtcagacctgcctagtacggtgtctgcaagagattgttgaatgtacctgggaatgccttatttgctactacccatgacaacatggatgaatcccatggacataatgataatgttgagagaaagaaaccagaaacaaaaaagcgcgtttcataggatttcactgatacacagtgcaaaaactggcaaaactcgtctatgctgttaaaagtcacacagaggtgatccctgatgggggtaggcaagtaggattgcaagggagtgtgaggaaaacgttttgggcctggtaatggtttggtttttgattatatgactgtatccagttttcaaaaattcatcaagagttatgcttttctgtatgtatattataccataattaattttttttttaattttttagagacagggtctctctctctcacccaggctaaagtgcagtggtacaatcatggctcactatagccttgaactcctgggctcaagccatcttcccacctcagcccctgaatagctgggactacagatgtgtaccaccaacccagctaattttttaatactttgtagatacatagatacagagtcctactgtgttgcccagactggtctcaaactcctggttctagcaatcctctcaccttggcctcctaaattgctgggatttcaggtgtgagccaccacacctagcctaattaaatatttttaatggaacaaaccaggtaagacaaacaaaaaatcttgtgtttgccacttcacaactgtgtaatttcaagatgtgacactcaaagtgtgatccgtgggaccagtgctgggctaccaattgttattttcacccttgggcaagtgcagaagttgagagtgagtgcttcaaaactcttctagtaccttgctgtgacactcaagtgtgtgatcagggaacagtagacacaaatcattccacaggtgtagaccagtttggttattgctgaactcacatgatatgtcacatggggcatggtcttcatataccatagacaaactatctccatatacaatttgaaaaatggtgattgcatgcaagttgcttccattggcacctcagtttctccattattaaaatgagagtagctatcctgatgcccccaaggatttgaggaagacaaaaaagataatgcacgagaaagcaccagtcagcaatcgctatctgtctggaatatggggcctgggatctgcatttttaacaagactcataaataattctcatcgggacgctctacctggacactgttctatgactgcagtgtccagcatggtgaccactggcctcacggggctactgcacttatgaaaagcagtggctagtccaaatgaagaagcgctgaaggggtaaaagacatatttgtaagacttcatacgaatagtagaatgtaaacaattccattcaatttttatgttgtctacagattgaaatgataatagtttggatacactgggttcaacaagatgtgttgttaaaattagtttcttttttttttacttcttttcatgagactgtcagaaaattcaaaatgacatctgtgggtcgccctctgtttctttttttaaaaattttttgtgggtacatagtaggtgtatatatatttatgggttacacgaggtattttgacataagcatgcaatgcgtaataatcacatctcgatagatggggtgtccatcccctcaagcaattatcttctctgttagaaacaatccaattatacccttttagttattttaaaatgtacagttaaattatttttgaccatagaccgcctgttgtgctagcaaatgtaagatcttattcattatttcaattttttctacccattaaccatccccccacccggtactgcccttcccagcctctgataaccatccttctactctctatctctgtaagttcaattattttaagttttaactcctacaaatcaatgagaacatgcattgctccagtgggtgagcaatggggtatttggaggctgggatcatctggaaagtggacagcaacaggcagcttagcagaatctgctggccaagttcacatgcctgccccttcccccgcctccctaaggttcctctaaaggagctccatccagcttcctgagtgaggcatttatttgtttgtttgtttgctggcttgtcctacagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcaggtatctctgctagaaaggaaaaaggaaaaaaggttgtttcacccccacttcctgattttccttgaagtggaaatttttcttgaattgtcaccctgtgatatgggtggaattaggacgatccagtccctagtgagttaccattgttgtctcctatgaagaaaatctaagtgatgaacttcctaaagtgtaaaaattagattaattaggtggcaagccactaaataatttgcccacagggttgcattaaatagtacacgtgtgtgtagataatgtatattgcacacaagttggttattaaattcattttcaggaacattctttttgccagaacaagacattagcgcaggttctcatgaaatacctgatgaatgaatgaatgaatgaatgaatgaatgaattactattatagggccacagtagtccaaaattacagactgccatcacccgtagggccccctctgccactagacagcaacaatgcagaattatttcagaaccttttttacagctttcattatcctaaatatgtatgcaattctggtctgcatacatacatattttgcacatggttttccagaaaaacatgttttttttgtagcttaatgttttctcttatctttatcccataagtgtttcctatgttgctacattgctttcgttataatgttctgtcaagtggatggacgtaatttaattatacattcccctgtggttggatatatttggtgcttccgtgtctttacaaaataacgcttcaataaacatgttacaaaataaagtttaattcattggtttggattatagctttaggaataaattcagaatttggaaaaactgaattaaaaaggatgtgggttttaatagctgttactacaaatggctaaattaccttcccaaaggaatagatatagtcgcattcctatcagctgagtatgagggaagggaggtctcatgaaggaaaaaaaaaaaggtagaggggaagtagttcataattgatgtaatttgcattttaaatgtgtttggcaaggttgactctgctttcacttctttgttagtacttatattccctgcacatatctgtttattaggtgtggaacgttttggttcatgcaggttactcgacagatcattgctacccttccccacactactgcaccttgaagaaacctactatgggcaggttgggcatcggggcctcctttactgaaggcctggaaggcttcttatccaacccctttcctaaacgtcctccctctatccatgctgtgtctttaaggatggcagcaaggggcggtggggagccagttgggaatctgtgctgaactcacctgcactctctgtttcctgtccagctccatccatgcctgagtacgacacagacaccccattgaatgagacagacacgaccatcacagtgatgctgaaacccgctcagtcccggggagctcctgtcaggtgaggatggttcttcacttggagtctgcagtttttcttctctgtgccacatgggcctccagttgaatcatgtgactggcaatgcccatgggcaagactggccaggagcaaagcttcctcggaggaaggaggtcagcagccccaagcccagttcaaagggagcccctgagttcaaggcaaacctgggtgacatagggagaccccgtctatacaaagaaaaaaattttttaaattagctggatgtggtagcacacgcctgtagtaccggctactcgagaggatgatatggaaagattgcttgggcctggaagaccaagagtgtagtgagctgtgatcatgccactgcactccagcctgggcaacaaagtgagaccctgtctcaaaaaaaaaaaaaaaaacaaaacaacaacaaaaaaaaaaacaagaaacatcctaatcaggacctgagatggtctagaaggaaacttcctggaacatgtttatggtaaatttagttagtggggtcggtggcctggaacacagtctcctggaaaggtcacttttctttgtgtcactgccagtaacagccagatagacaggtttgctgaatactgaaaacaacctgctcagatatcacaaatctgacaagacctggggactggtccagtttaaggctgtagggtgctggagtcccataggggcacttgctgtcaaggtaaaactgctgattttaccaaacgtggttggagatcaggaatacactgatgcatctccatagttaaactgaccactgctagttcatgatatcaggagcgtgggcatctcttttaaacaagatacactttgcacaagggcagcaatattgactgccggttttgcccagaactccaggaaggaggactacagtcccttaaaatgaagcagagcattgagtggaacaactttcaaattgctcagttcaattcatcaagcataaactcagtatgttatgtaccaggaatgaggcggggcccaaggcctaaaaaccattcattcattcattcaacaaacatttttttttaagaatccaccctgtctcgggcaatgcttaagtgcttggaaacacagcagtgaactagccatggataagtcacatcctaaagaaagtcaaactctagttggggagacagaaacataattacagtacagtgtgtcgttgtggagatacgcataagagctcagaggagagaattcccagtggggacactgagctgtatcttaaatgatgcttaagatttcaccaacgttgtaagagtgtccagtgtgagcacaggcatggaggagagagacagcatgctataacagggagcaaccagggcggttgttgctttaacataaacatcaaggtgggagtgctgggatgagaatgggagtgtgtttgagaggctcaggcctgtttgaaggacatgggcagctactagagagatgcatgcagcctcactccttgtgtcactggaggctaggacaccagcccagaagggggcttttgagatggtctagctagccattgtctatcctgtatccagcttcatctagaaatgataggcattgaaatagacagaaccaaccaccaccaatttagaagttcctatgtagtctgaagtctttggacaatgctccccctaagtcagagaagtctttacactttccctctgaatctctatactcttggttttgcatgtctacttaacaagcttatatatcgtaagactcaacaaattatgaggagggataaggggatgaaagtttcccagtagcaatgagaaatgacagttgtcagggtgcaaaggaatagcgcaactctacaaaacagacacagggactcaaaaatcaagcaggcctacatgctgtcatccctcatagccattcgtgtttattacttggtcctggtttaccctgaaaagatgggtctgcaacttacaggagcctgctagctttcatttaaggaacaagcacttgctaccagcttgtctctatatataacactacctgtattctcgcaacattgtataatagtctcctcattttgcaaatatagaaattgagacaaacagaagctaagtcagttgactcaggctataaagccagcaaacggtacaggcaaaatttaaacttagttcaaatgacctaaagccaacactcattttactatactataccacctcctaggagaaaggtgtgcatgatatattttggtgacatttttatccaaaaataaataaataaataaataaataaataaataaataaataaataaaagaaatgtcactgctcaaaggggaaatggttggtgtctggaaatgtctggctgcttttcctctcaaggctctagagcattgagggtgggtgtagactcagtttctggaattatttccagactgtttcttgagcatttgactagaaggggaagtgactaaccaatgccacccagcacgaatttcaggacaactggaaggacagaagtggaaatatcacaatggatttcagttatcttgaccttcattcaccttgaactctgggcagtaggatgttatatgagaggtagttgaccactaggtcatgcaacaaatatttattgaacacttagtatgtttagggaagtgagctaagcaatagggatacagtaaggaacaagatagccacacctctgtcctcttgaggctccagtaaattgtttgtgagtgaggcagggaggtgggacattaagcaaacacacaaacaaacaaaatcatgaaattagcaaaaaaagtgtcactgaacagaacttggtctgtttgcccatgcacaatagaaagccaaactctgaagtactgtgtttttgtagagagaaaagtttattgcaaggctgctgaacaaggagacaggagtcaggcttttggaggcggggacaggttttataggcagaaggtaatggcgtgatctgattggacatttgcaatgtcgtgatgtgggagacttgatctgactggatcatgtcatgaggtgatgctattgaatcatggatcatgccatgtggtgttcacttattaaactatccccattccttagtccaagcacctaggtcccaccaatggtgtcatgcctggtgcatctggtgtgctcggcttatgtttcttgcaacccaggggtattgagctgcttctgcagttccactgtaagatgatatgaaaccactaggtacattgactgtagtgattgagagaagcggtagactggctggacagatgagcaccacccaggaaagcagagcagtgtgcagttgtgtgagttggggaggtgaaggatggagaaaacaatatggacactctatgatcccaggactcaaagaactcactagatgcactgggttaaggatgcttcgaataaattttacagttaatagttttctgaattagttttctgaattgttcctttacttccattgtattatctgatcctcacctacctggtgagtcagctggttgggaaataccatctccattttggagcaggaaactgaagtctaagatgttaactgattggcccaagcttgtggggcttgttacagttaaagacagtgcatagacctagtatcctggctctgagttcatggctcccctgggaagttctgagttcctctgcctggtatgtcacgtgatgaccgggtggcccttttgtgggggtgctacggagtaaacctccaccaaccagggcatgaggggtgggcaagaggaattctcaggggtcctccaactctgccttgtgtgagcccggtctatcacttgtgagcttcagtgggtccctctttgagtggagctgtgtgttctcaaacagactcacacagaaactttggccttcagaccccactcaggcaggctcttctttctgccagtgatgctccaaccctggctgagccaaactctagcccctgctttgccacttactgctcctctgaagccctgtggatctgactctatctggtagaactgagtgtgcaggggggcgagatgtggcagggaggactgttgctgtgtggggctcccgcaccctcatccctccagccaaaccacctcagcagcttggcctatttttctaacactccacaatggagatttattgcttttgtattgctttcctcaggccttcaaagatttattggtttttaagtgacagaatcccagaattgcttaaaagatcaatcaaatagtgactagaatctaatattcagttctggcttgaacatgccgagccttcttcccccacgccccacctgtcacactgatgtgtgactgatccgtactaaccttcataagaaagtaacttagccatgaattagtcacctataatgcagtccctgaagtgaggctgggggcagagccccaggttctataacagaccgtcccctgatccctgaagacttccttggaaatgttctttccccctcattcctccccttcccatctaattagtcatggagactggtcctctggacttcagaacctgggccaagctctctcttcttctcccacattggcactttccagcctcatcctgtggacctgcacccgccaggatatgcttgctggagtgcttgctgcagcttctcatccttcaatccaccccccactgaactgctggagtgatcctttggaagcacaaattggatcaagttaactttcctgcttaaaattcttaaatgggtcattggttttccattgcattaagtacaggcttcttagcatggaattcaaggctcatcagaatctgtccttagccttgtttccggtttcctttcatttccgtctgcccctttaccaggttttactcaacagtgacctatatagttccttcatagttctttcctgagcctttaattgtgttatacagctgttcatatatatatattttttgttttgttttctgttgtttctacatacccctctataggctgtgagctccaagaaatctgaaggcttggtactactgaattccctttacatgggatagtgtctggcatcatacatatatatacacacacacacacacacacacacacacacacacacatatatatgtatgtatatatatgtgtgtgtgtgtatagtaactagttttatatatatatgtatatctatagtaactagttttatatatatgtgtatatctatagtaactagttttatatatatatgtatatctatagtaactagttttatatatatatgtatatctatagtaactagttttatatatatatgtgtgtgtgtgtgtgtgtgtgtgtgtatatatgccttcagctacctcttattctgaaaagagtgctgttcaatagaattttctgcagttacagaaatgtcctatatgtgtgctgtgtggtatgactgccactgaacacatatggccattgagcaccagatatatggctagtacaactaggaaactgatgtttaaaatttttattttaattaatttaaatttcaggagccatatgtggctactgactgccattttggatggtaaaggtctacaggaaagacaatcagaaaaagaaaaggtgccaatgagcctgtgtttggccagcttgttcagaagtttccatgagagttcagtagagaggcagcccttggtagaatggtgagctcagaagctgggagggcttcctggaggcagtgttgcttaaattgagacctagggaatgaggaggagttagtgaagaagggaagagtgtaacctagaagaaagagcagcctatgcaaaagcgcacacagagaaggtacagggtgtgtttggggagccacaagtagctcagtgcgtggggacagagagatgaggagagaagcaaaggagcaggcagggtccaggtgaagaaggtcttcactctggatttagactttgttcagaagggagtgtggaacattgggaaggtgagtgcccaactgtttgtccttctctgagcaaacaggcccctagtccatgctgttctctccaccaagcatgccattctccacctctccaacatccggttcacattggccacatccaggaccatctccactcttgcagcagaatgcaccagctccttctgagttgccactctgtcatggtcatccctctgtcagtgccttgcgttgtcagcctctgctagactgtggcctccctgagggcagagatgggtcccatacggagctcctcactcagacctaagaccattatgctcttcctgccatagctgacttcccagttggatacactgaaacaggagtggctcctaaaatcagaccagtcttatccaattgtcccactgggtatactggaagcaggtacttattttctctgaaccgtaagttgcttgtcggtaaatgggaatacctacatcacagattgttttgaaggtcgaataagctaaactgtgtaaattgcaactggtaattgttcaacatgctctttgggggctgggcctgatggctcatgtctgtaatcccagcactttgggaggctaaggcaggcagatcacctgaggacaggaattcaaaaccagcctggccaacatggtgtaaacccatctctatgaaaaatacaaaaatgcgttgggtgtggtggcaggtacctgtaattccagctagttgagaggctgaggcactagaatcacttgaacccagtaggcagaggttgcagtgagctgagatcacaccactgcactccagcctgggtgacagagcgagactccgtctcaaaacaaaacagaaacatagtccttgtgtttggccaagctgttgaggcaaagagtggctctaagccatgggcagccatgggcaagaattttctctgagccctgctgcaagccaatgcctatctgctgtgtatcctccagcactcatgtgagatctactacatgcgaagtgctggccagtgtagggcacatcaggaaacctacactcatctccaggggtgatcttcaaaacaacattaccttaaaaataggaaagacaatcagaaaaagaaagtgcctatgagtctgtgaacttggtcagatatgagcacctttccgaaatataaattcaagcagacaagcttgtagtatctcattgccaaagggccagcacagtcggggttaagagcaacacccttgggagacagttacattgttcagataagaaatgaaggtgacccaccactagagtacttatgacgatgagatacaacttgtaagaggtaaaatggacatggcttgtgatgacttctccaaggggcagggtgttggggtgtgaaggaaaagacattgtccagcatgactcccagttttctggcttggttcgtgggatggaaagtggtgccattctctgagccaatagatgccgagggagggaagagtctatgaggacatttcatccaggaaaggcgaatggtggcaaaggtggtctgggaactgaatgggggagttaggaactcagctgagcaaggacagctgcaacctggcgtgtggtctaggagagtgtgggggacttctaagggaccttttacaaggtcagttaggacatgagacctgctttcttaggttgcttgaggcatggtgcacagggtgtgggaattctagcctggaggaccaggggtatgaaagatggaaccctagaagacagtgtaacaagatatatacttctaaaggtcattgcaagttctcttcacctcctgatgagaatctgtgatccttttgcatttgacaggtgcagttagttaagaccatagattctgaactgcacagtgattagctacagtaccaattggagatacagcctacttttaaagaaagaagaaactttattgggaagaaaagcaaacgattgccagatttccttcaggattcctttaataactgtgaagcccagagtgggagcacatgaaacaatcacagaggggttttgctggtccatgaagccgcagtgagcaaaattggaatcattaccgtctgattctcagataccagcatatgatggtgtccaattaggaaagagaaacgaacatttagaggatttattgacacagggcagcctgaggagtttgtgaggccttgtccacattgggaaagatgagaaactgtaattacatttagacactctttctccaaacctcatttattcacttagttccccagttctctgggccacctttgctgggacctgatgatgaggaatgctatgggtcccactttggtgtattgggggttagggggacatggataagagatacccagacataacctgggagaagacgtagctttgttaacaccacttttagccatgcctaaaatcacgctgggacttcatcacaccagattgggaaataggagaagccagatatatgaagaggtaaccagaaataaagaataagggatgaatgttactgtagtgcccttctccatgaggttgtcccacagtctacatatgccaaccattgggatacatattgaagggttatgtgtgtaccaccaaagacatcaccctaggagacaaaggtcagtctggtgatatagcacagagctgcaattagatgattgttcaggaaaacaaaagggaagaaaggtgacacccaaataatgtaggtgggtttgcattcacttcagcttttaccctgactgcatttcaggtccccttttataaggctccttcctccaccaacaactcagcttaccaagaattggctctggtgttaggattctggattatattacttaggctccaaccaaggaggaaaaacaggtgtttggggaagaatattttaaatggagcagtcgatggaacatgaagatcgaaagagtgttctattttggactgtctgccatctggagagatggagacagggactgttactggcatgagggaaagaagagtggttgtcatgctcacctcctaccatagggactatttaaattccaaaagtctggagtgctggagaggcatctgagcaggggttttagatttgggagtcattagcatccaggtggtatttcaagtatggaggggagtggatgacctcatcctgggagagtgtagattagaagagatgagaaacagaacagagagctacgaaactttatcaaggaaacacacaggagatggagaaggactggccaaagaggtagaaggaaaaccagggctgtatatttcattttgacttttcttttcttttaaaacaagaaattcaagggaagaatcgtttaatttttttttaatcgtttaatcttctccaggagcttcaagaagctcttgtagtagaaaagaagaaagacacacaagttgatccaggactacagagaaatgaagatgatggataatgtcaacaaaagtgctggaaaatggaccatctggtgtaggcttgctttaaaaagaatgtgaaggttgctgttcagaaaatagatatattgagggccaggcaacctggatgctgttgaagaatttgtgcagagggtacaaagcagggagagtgtagaaagacaggaagtgctatttggagaataagatgatcaaatataaggtgtcagtaataaaactcttctataggatatgatggctctcggtgtgaccacattggcagtgatggtgaacagacagtaatagattcaaggtgaaggtcattggagccaaatgttgcaaggaacacgaggccagactaaggatggaggggcagtccaagtagatgtagttcttataatacaaaccctccaaccctggggaactggtgaaactccttgaaagaactcggtgaccttgcaagatgccttctcctggtccttactttttctctaacttttttttctgctgacttttacttctcccactgttctgggccccatgagagtttgcatcgctgctttgtctcagatcttgcacagctgataaccgatggctctcggtctctgtccgcaactgcccaaaggtcagactttcaagtctgcttccatcaagtgcatttctatagcctgatctattgatgttcttctgagttagagcatggctctgtgccatgttagaatccaaggaggtttgctcttatccaaaaagcattctgcacgatgcctgctccagctgttgagggctgctcagggagttgcctccacttggcaacagtgagagaagtgattctgaaagccctggctttttggtaggaaaataacatcttaaagttagagtctccaccaatgggccaaaaaaatgtgtggttactctctcagaatacaattcacccttttcttacctggctacagctgcttagggtttgctatttagtgcatttccacttaggtataggcttacgaagaattttataaacatataagtattcatgcccagagcaagatgtagcacccccagtaacaactgcaagaatcgagggctagactttagacttacactgtccaatacagtaactatcattaatagctacatgtggctatttaaatttaagctagttaaaattaagtaaaattaaagcttcagttcattggttgcattagccacatctcaagtacccaatagccacaagtagctagtggctgacatactggacggcatttccatcatgacagaaaattctattttactacattgctctagaccctaagaaggttggtaagaagaggtcaaggcccatgtttggtttcagagaggttatttggcaggcgtttggggagagaggtaaaggccagggatcctatcataagagatgagcaatgtaatgaagacttagacagaggtataggtcctgaaaacagcgtgggacctatggctgggcttacttactgtggagattctgatctaccgagctagacttctaaaatttccccacatcacttccactggatatagaatgtgggaagtggtataatcccaaggtttccaaactttaatgaacatcataatcagctggggttctaataagcctgcagagtcctgcctgtccccaaggactataggataatgcctgagaatctgcattttgaacaatttcccaggtgacctactggtcttggaccacgcttgagtactactggtgtggcctatgggtggcctcaggtatggagaaaggaacctgtacagggaaccaagtcatctcttctatggcaccaatatttgctcattcttgtgatatagggaagcaatagttttgccttgttctgtgaagttgcccctgttgagtttacagcttttggatctctcatgtctctctcagtgtgtgtttcagcatgaggataaccagttttagctcctaaaagctgaactagaatctctgccagcttatttctctatccctgtccacgtgggggctaaaaacacacctctgttttcctatgatgatgacaataactggtgtcaaaataattcatgttgtgttgttgcatgctgacagcatatctgaatacggtcacttctatgcggatgttggggactaggtagaagatggatgtttgatgaggctgaatatcagaatatcagaatctgaacaaatctgtgttcttttgtggaaggctagagcagcctgggagaaacaaatccacttccaactttcactctataaaaagttccatattttcttagatcagacaaaatatattgagtgccaaaatgctgcagcaatatgcacgcgtcactcagctgggttggaatctgtatgcattgtccccccgggccagttttgattatgttctttttccttttattgtagtcagcaaatctgaatttgctattgtggggagagcaggaagaagagagaaaaaatgaaggtttttaaccttcagacagttcagaggttcagtctgaataagcacaaaaactttcagtgtgcctctgaattccttgaatttgcagaacttctcagaatcccaagagaactaccttgcacataggattcaggccctgctttgtggctaaaaggcaaagctgaaattatgagagagaaacagagttagaaaaagtaggaagaggaatcaatgttttttttcaaaaaaaggaatttggtcccaatccaggctaagtttcagcctattgttcaatttcttcaattcaaagccatctgcttcccacggctctcagataacgtctcccctgccaggacaccctgttcctgcttaattgaaattagtttccaagaatagttgtccaaagcagtttccaatggtgggaatgttttgaaagtcacaataggagttgaagctttgggatgcagatgttcaaaggcatcacatggtctacaacagccatcatatttccaaagccaggagttctctcattggcctctccaactcacaaatggctcctctgcaactggcaccatctctctatcagggacatgtaatactgcaagtgtgaagggaaacaatcacttccattcaggtttagagcaatgtgtttcccaggcttaattatactgcaggtatataaattacagaaacatgttaatgctcccatgattaaaattatagagtgcctaattgaaaaagcataaactgaattgaagaattcctaattatagtttgctttgaggtgttaatttcctccataacgaatgcataatttcttggaacctaaaaaggtggcctctgcctcagcccataggctccaggcagatggaaaaggtagtcatctttcagttcaggaagctgacacgggaggctctgttcaggtctggaggctgggagagccttagaagggagcttaggaaggaggtggagctggtacagacatcacaccaaggttctactctatttagtaggcatcaggaccaaggcagataaggaacccttattaagcttttccgtcctgcctttgcttttcctctccaaagtctcaaccattttccaagctggtattttgtgcctgtaagacagtaattctcaaagtttggtcccagatcgaatactgatgtattacctgggacttttttagaaatgcaagtgtttaggctctgtccccagccaactaaatcagaaactctaggagtaaagcccagcaatctgtgttttaacatgtcctccaggagatgctcatgtgtgtacagtctgagaagcccagtcctaaggagtgggtcatacacactcaaagtcacatctaactgagctttgttgagctcctcctctagatcagaacctgagatgagaacctgaggataccaagcatcctttcattgactgtacactcacaatacagccctgaagtagaaaaaataatcccctgttctcagtagagaaaactgagatcctgagaagatggcttgctcagctcatagtatcttaggacctgtagctcttgtaggttctgatgcagactcagatgcattatgttacattttttcattgttgtcatataattttcatcaatagctctgctaagaaatgggttttctgacacattgtaagttggaggtcgaactacagcttggaatgacttccaggtgaggcttgactttgctaatggtgagtctaactgtagagccagggaagggggggcttctaaatatctgtaagcattgctattagtggcatcaattgtgagtatgcattcttcctgaagagtgatgcaaactctaagtatgaaagaccatgccacagctcaaaaagaaactcttcagttttgggaaaaaactccccttgcccagtgactgaagtagctgcgaggccccctattaaggactctggaggccacagaaagttgtctagagtagagatatactacatctcctcctctctttagacatccagtttctctcaggtttctatttcctagtctaaacacatcagggactttgtatgtgtgtgtgcagtcagttttagctaatccacagccatctgaaacaataaactcatgttcttggtttatgaaattttgtcagctttttgcgtaattcttagctatttccatatggttgaaaatttgggtcatttccagttttttttgttataaataaccaagcaatcacaaatttattcatgtttttcttttggtattgtacctttaaatagcaaaaatccccaggaatgcaattactgaaatgaaaaaaattgaactacagtgtactgagtgccttctctaatatgccaggcactgacagccaattcatatacattaacctttttcattctttaattaaaaaatctcaaagtaacaaatacacatagttggaaaatcaaatagcccaaccattcccaacaccaccatttacaaccccccctcccccagtcctgtgcctcagaggcaaatgcattttaattctttgctctttcttctgggaattggcaatgtcactacataatgtgctattttaaagttatcgattgcagacattatctatttatttcctgctatgatagatggtaacttgtctgtcttaaatcatccaatacctcccttccttctttccaatgtagttaagccacagttttttgttaaataactacacaatggccaactttacaattccataaaaacaggtcacttcagagccaaatggtatattacttcttttacagtataatataatatgtaagtattatattattacataattaatttaaagcttgctaagattttaagttctttatgtatattaactcagttgattatcgtcaaaaccctaccaggtagaaactagtattatccctattttacagatggggaaactgaagtactgaaaggttaactaacttgctcaagatcatgcagctagtagcagccgatatgaaatttgaacataatggtctagccccacagtctggagtgtactactatgttatactacttctaattactcttcttgtgggcttttttgtttaattcgttatagaatgtacaattattctcatttcttcaggcagtttatttattaaactattcatacatttttcctcccacagaactccatcattttaggtttgcctttaaatactctttttccccttttcttttctgccaatttcttctatttcctaaaacaaaacagaacaactccctcaaaaaaattctcaaatttgtttataattttggcagtcataatttttcattttgagctacttactgttctttgaattttttttcttataacattcacttcttatttatagaagtaatcatttctcaaacatctcaggatattattttgattttggagaagggggaagcttttctgactcctgtattatctctgtttcttctagagtcattttttttaattcactgctctctttcatgttggaagcattgcttacctaaccagtgaacctccatagccaatatttaaaagtaaggtgttgagaaagttgactggaggtgctgtgcttttggaggcggaggcattcaaattctgaaatgaaatcctcttcctatctcctgcctaaggggtagagggcagacacatagctctccatgttcaaaggtttgatggttttgtgtacagacttttgataaacaccccttttcagccccacattttacttccacactgtccacacttgactactccaacatcagaatctctcttgaaatctgtggggcaaataaaatccattcttactcacatgtctttgcaatttgactttctttatctcatcacatgtggtacctctcctctgaccatttttaggtttccagaattttcttaaaactgctcatccactgatgtcccctctcctgtcctctttttccttgtggatttctatgctttttcacatttcactgcaataacagtgaggagatagaagaggtaaatggagtacattaattcttccgcttttaactagaagttcacttacattattgtctattgcagttctcaaataacaaatgatggaggcattattatcgtattcagttcttataaatgctatcatttaaataaattaaggaagatcacataaccagtgagattcagagctaaaattcaagtttaatgctgattcctgagcctatgctctttttacttccaggtcataaaaacatttatgtcttgaaaaccattgccagattattttccccaatttgatgaatcaattaaaaatgctactggaattgtagaatcctaccagttcaaccacagcttcactgaaatggcttgttataatttatgcttacttttactaatttaatgcatttaaatgggaacatattgtcattttgatttgcatgtcttggcttactggcaaggcagaatatttttctaggtatttttatgctattaacatttcttttttgtgaattttctttttacatccttttcctaattacctatggcagtggttctcaaccagcgttaatttgtcccttaagagatatctggcaatgtcaggacatatttttgtttattacaagtcggaggtgatactggcatctagttagtgagtgggggtcagggatcctgctgaacatcccacaatgcacagcacagccagccccctacaacgaagacttatccagcccaaaatgtcagtagtgccaagattgagaaactctgaaccatgggggtcttaatagacttttttttaaaaaaatgtatgattcacaggttcttgatcttttaaatttgaagacccctttacactcttaaaaattaatgaaggcatcaaagaacttttgtttatgtgggttttgtctatcaatgtttactgtattagaaattaaagccaaattcaagccgggcatggtggcttatgcctgtaatcccagcactttgtgaagccaaggtgggcgggtcacttgaggtcaggagatcaagaccagcctggccaacatggtgaaaacccatctgtactaaaaatacaaacattagccaggtgtggtggtgcatgcctgtagttccagctactcagcaggctgaggcagaagaatctagcttgaacgcaggaggcagagattgctctgagccgagattgcacccctgcactgtagcctgggtgacaaagcgagactccatctcaagaaaaggaattaaagccacatgttaacaaatatttaaattcatttaaaaacaatactaagcctggctgggcgcagtggttcacgcctctaatcccagcactttgggagggcgaggtgggtggatcacgaggtcaggagattgagaccattctggccaacatggtgaaaccccgtctccactaaaaatacaaaaattagatgggcatggtggcacctgtgcctgtagtcccagctactcgggaggctgaggcaggagaattgcttgaaccagggagtcagaggttacagtgagccgagatcacaccactgcattccagcctggtaacagagcgagactccatctcaaaaaaactaagcctatacatattaatataaataatatatttttatttccccaaataataaagttagggtgaagagatacagtttcacattttgcaaatcttttttaatgcctagcttagtagaagataattggattatcatatctgtttctgtgtttaatctgtcctcatgaattgttttggttgaaataaagaaaatccagtatcacatagatacataattgggaaaaaaaaggaggaatattttaatagccatttaagatcattgtgggtattctcctctcatatgacaccaaaactcagagtggtggtttcctaaagtttagttgcaatgaaatatcagtaaactttttatactcttttacgttaaaatttatatctgtcttgcacttgagtgcattctttgccttacatgattttgcaacgttatgcattggtcatttgaaaaatattcatggatttattttaaaaattccaaatgtttatatatcttgttgtaccatatcaaaatattacatttgctactgtcaccaccaatttcatcattaaaatttttaattattgaagatctttacagttcacagtggcagatacaagttttccaaattctagttttcacttgaaagctgccttatgtctttgacaacaaatactgtcagttttctttacagtgacagagagacttcgtttattctcaaaaaaaaaaaatgttttccacatatacaaatctgaatgaccacagttcgttagtcattctttcaagaattaacaaaaaggtacctcatgaaaaatgtggctagtttagcattcagttcaagcaatcacagaaatattcttttctggccgggcgcagtggctcacacctgtaatcccagcactttgggaagcccaggtgggagaatcaccaggtcaggaaattgagaccatcctggctaacacggtaaaaccctgtctctactaaaaatacaaaaaaattagccaggcgtggtggtgggcacctgtagtctcagctactcgggaggctgaggcaggagaatggcgtgaacccaggaggcagagcttgcagtgagccgagattacgccactgcactccagcctgggtgacagagtgagactccatctcaaaaacaagaaaaaaaatgtttttttcttgaagaaatcatagtacctgaacaagcaggagacatgatttgtgtatactgcccattgtatcacatgaatgtgaaaaagacatggactcaagggttgagatttaataaaattaatgctttttactgcttcatcgaggaccttcttaagtgaaactggcatttttgcttttatagcaagtatgaggtggtgaagaatataatgacaagtacagttgggtaccactgccttgagttctcctgaggcaccagcagtattgcctacctttccagggtcaatattaacaaagtggaaaaaggcaaatgaagtcttagtattactattacaattatgtcagtgttacagaatcattgaatgggtctgaagaactcccaaaggacatctctggaatttggtatatataagaatatcacggtgaacctgttcaaaatttgcattcccaagcctcacactcagaggtctatcatgggaatccagaattcacaggcaattctgttgttggatggatgagaacctccaattctctgtgcatacacgattttcacctcattgcacttctgcaatcctcaacagtaggttacgtcttcccataagaagaatatttcaactggtgttataatttttctcttgcatttatttgccctatctggcaaataagtatgcctgctattacgattaatttaatgcttaattagtaattattccatttacatttttagagcttagaagggctttttgaagataattgatttcagatggtattatatttaaaaaaaaaaaactgttcagagagatttcacctgatactttcctttccttaagcaaatgtctttgttgcaaggggagacatccaggcgccctactgattactcttttaaaaacaataacatcttcctctgtaaaagcattgctgtgggttctaatcgccaagttaggagctgaatccccatggaagctagtcttgtttaacttgattttttttatttgctcctctcaccatgtaaggtaactttagaaaacgacatttcaactgagaacttgacaggagtataaagggggttgcttcccaggatgtctgaggtttgagaggcccggggtaaagaaaacagcctggctctccactagggtacagaaaatgattcagaatgtatattagaaaacaaaacaaaacaaaaaccagcaagctttccagtcccctaatgtgttctgtttcacattactgcttttcaaaatttaatgtgcaaatgaaataagttgggacctcttaaagtacacattctaatttaatagagctgaggtggggcctgggactctgcatttccaacacatttctttttaggtgatgaagatgctactggtctgtgactacacaggagcagggcccctgcagcattctgcttgttcttgcttctgttggttagcactgtttgctttgaatgctctatttgttaagtataacaataataaaaaacaagtttattatttgtagagatggggtctcactatgttgcccaggctggagagcagtggcgtgatcatagctcactgcagcatcaaacttgatccttccaaagcagtgggatcacaggcatgagacactgtgcctggcctacatagactacatagacttgcttaaagttattgtttaattgagttattaacataagctaatagagctgttggctagtggatattttaattattttttatttattttatttttttgagatggagtctcattctgtcacccaggctggagtgcagtggcgtgatcctggctcactgtaacctctgcctcccatgttcaattgattatcctgcctcaccctcccaagcagctgggactgcagacatgtgcccctaccacgcccagctaatttttttgtatttttaatggagatggagtttcacgatgttggcgaggctagtgttgaactcccgatctcaggtgatccgcccacctcagcctcccaaagtgctgggattacaggcatgagccaccgctcccagccagttattttaagctgagtcaaatatcttttatacattactggattcttgactgattgaaattatacttttcaacatgtacttagaaaatagcacttctggagtcaagtagggatgggatctatttcgtaaacattgaatagtcaacaatgcccagctgggtagagagtattaggcatagattatgccatgtcgttcatgtggataaatccatccatcaattaaaaatatgatactacagctattttgtaacatattaaattaaaaaaatattttcaaagtattttcatattcctatctttgatccttatcacaatactaaggtaattcatacaatgttatcattttattttaaatgatgtttaagttagagtcaccacaaaataatgcatgcttatatagaaatgataggaaaatttttaaaatactgacatttgggaaattttccctatttttagtcaccaaattaaaaaaaataggctttatgtaaggttgatcctccctgataatgttgcatccttcttttgccacatatcatgatagctattaccattttaatgatgtttggggagtatttattcttttgtttctccaagtagttgacagatttcctccacaccgtttattgaatactccttccagtcttactgaacggtgatgttgcctgtgtgtgtgtgtgtgtgtgtgtgtgtgtgtgtgtgtgtgtgtgtgtgtgtgccactatattcttggtttatactgttccattagatctgcctctctgttggtcactgtgtctgtatcacccattttaatatagctttacaaaacattttaatatctagtcttcctatttcttgttgttcaaaatgttcttggctatttttacccacttatgtttccctatgaatttttaaatccctttatcatattctctaaacaatccccaatggaattggtctaaattatattaagactattgcttaatctaaaatgactatatgtattaacgtgagcttttccacactgaaagagggcaagcctatctattcatctgagtcttgactatttctcaggacgtaggcattgactctcatgtagactccatccatagctaccttgttaaaattgttttactaacattaagcttgtggtgtcttctgctatctgtcccctattgtgtttgctaactggtttttgctggtatttagggaaactgtgtgagagagtgtgtgtgtggtgtgtgtgttttcttcatctcattcactgaaacctcttgtgagtttctttaattaagttttattatcttggtttaccagctaataatcacaccatctatgaataatgataattttatgtcctcctattacagttgcaatagctcttgttttggttttatgttttgttgctttgggtagagctttccgggcaacgttgccaaataatattaatagctgaactttttgtctaaattccaacctcaaacactagacctccagcaaatttctcttacgtataatgttagttgtagatttgaaataggtattttgaaatctgaaaaggaaaactatttatattctatagtttatctttatgactcttttaaaatgagtgattttatcaagtgcctttttggtatctacttatatgatcgtacttttcttttttctacttggatttatttatgtgatattttcctagattttctattactaaatctgtcttgtgtacctgcagtaaatgatccacttatggagcaccaatttaatagtatgttagaggaatagtttgtaacaatttgagatgcttttcctctttttctgtctgatgtaattgtttctatgacatgggaattatccattcctggaagattgaaagaactcattggaaaagccatctggctctagtgttgtttattctaattttctctttatggaatgcttaattaatttattgtcattcttttttgtttagtaacaaaggcttttcagatgctgaaaacaggtttggtcctgtcccataagcattaaacattattgttctcacagtaatagtttctaaagagcaggaaattgtggctttgattttctatttgatatgagaattacttataaggcatcatataaggtaagttcctattttccccagttggaggttttcatttgtgcagaattttgatttagcaatttctggttctatcccattatatatacagaatatagactatacctttattcagataatttattgatttttatgtgtgtcctttgtcatttttatccgctgtacctgatatgatttttaaaatattaaaatattgcttccttctctgtcatattttctgggaatagcttttctaattggttgttttattttttattctgttttcagacatttcagatttacatatagacaaatctgtcatttttcttttgtcttttgtaaattgttctattattaagcttaaacaattcttttccactcaagattatctttttctttgatttcaaacctacaggatattgcaagaatgagacaataaccatccacatatccttcccatagatttgccagtcataagcattttgccatatttagtttctctctctttctcttgtctctcaaatggttattcaaccatttgagggttacttgtagtgaccatgacgcttcaaaacctttagtttgtatctcctatggaaaggtcagtctgttacatagccacaaaacaatcatcacgctcaggaaatttcaaagtgacataatgctggtatctaatatataggtcacattcaaatttccccaattctcccaattaattgtcctttaaagctttttaaaattcaatccaggatccaatcaaggatcacacattgtatttggttggcaagggcatactaaaatttttcagtaaataaattaattctgaactattggaatataatgtggtttttcatatgtagcgaggtcttaaatttgatgatttcatctcataattatggaatttctgaaacactaagtgataaaattttctttttcattaatttatgttgcgtgtaattttatacataaaattatatgtttctctctctctgtcatacacacacacacacacacacacacacacacacccctacctagtccatttttatttaactcatactctagtacccatggtttaatcattgtaacttcataatataacttaatatccagtagtggtttttcagcctcattcctttgttgtttttttttttttaagttcttaaccatatttcccatttgaacaaaacaaatcttactggaattgtcaaattatggccatccacatctttagggctcacaaatatcacctaactggctcatattttatacaatttgctttttctcaaagaaaacaatacatcaatttggcaagaattgacatttttacaatatatgatgctttcctccaggatttcagcctttctgtccatttattcatcttcagttcagcacaattatttaacacccactctaccaagccgtgtgctaggggctggagatagtcttttaaatcattcagtagagttttattttccttccaatgtcagtcctatacgtttcttatttgtgttttccttagctatttttaaaggactctattctaaaaggctttttcattacatcttctagcttgttttccatggtgtacagtgtatttatttccatcttctacaaaactactttactgaattcttttattaattttaacagtctttcagttgatttgcttcaatatattaggtctagtcatgttatctgcaaatgacgatgaattgctttcctttctaaaatgtgtatctcttctgttttgtgtcttattgcattggtcacaattattccattttagaggcaagttctagaggtaaagtgactttctcagcatggcagacagagcagcgagtgtgaagccagtactaaaacctccaccttgctttagcaaaggtccccatatcaaggttatctacccaaatattgcctaactggccccatattgatccagccgctttttcccaaaggaaggttgacatttgcagtgcttacagttctctcttaaaaggacctaatctgttaggtgtggtaggtaaaaattaagagggaaagtgtaattggctatattgtggatttcggttgctattttaaataaagtggtcaggacagacttccctggcagaggtgaaaaagtaagccttccttaggttgcctatctccaagggaagaccattcaaggaaggggatagcgagagcaagggccttgaaatgggagcgtgtgtggggtgttcagggaacagcaaagaggccagtgtaactggagaagaattagaagagtaagatcagagagttcttaagagtgagtcttgtagacattgtaaagatgttgcattttactctaagtaaggtcagagccataagggggctttgagcagaggggagtcttgagctgagtcatgtttttaaggagtcattctagccactgttttgagaataaattttgggggcaaaagtgaaagcagggagaccagttgggaggctattacaataatccagttaagagatgatggaagcttagttcagagctgtaactatgaagatgctgagaagcagtcagattctcaatatacagtatattgaaactgaagccatgggaattgcttatggactgaatctatggtattttgaaagagagaagagccatgattgagggaaaacttatttggatgcttcaactggattttcatgattcctttacccaacatattttcttcctctaaatttctacacaaaattcactttcattaaatgtatcaaatgcaattcaatcataggagaagggcccaaataagaaacaaagccactctttggtgtctaattcagtaatattgtaataataatgcatgcagcaattgtgaaggctccagccaactttcatagagcactttctagaatgcacttcctagacatgtaatttcagtctttgcactgccctgtaggttcctcccttcccagaatccttccctggcagagttcttgctgccctcacttcattggattatagtgaacagttcattatttctccactctgagctctaagcacccagtacccagtggccaggttgcattcaaatttgaacctgctatgtttactttattgagctatcatcacccaataaatgtctgatgaataaatgtataaaagacagacagataggacaataggtcgccgaactagtcagaggcaaagcaaagatgcacgtgcactaattctgacactaatctgccgaatgtacacctcctcccattttcttgtctcctctgcgagctattttgactaggcaaatagtgagtaaaaacaggaattcccagagtcttggaagaaaggttggctaactaagacatatcattgtaaatttcagctccatagttctgagtgacctttaagcagggaatgtaattgcaaagctagattctgttgggcattacaaagctcacacttgtttcttagcccatcttatcctataaaaccaatggtttatcatagcattttgtattaaaatttgtgcatacttaaatgccaaagcatagacttttgaagtgtgaaaggacattgaagattattcagtctgtttctcttaacagctttattgaggtataatttacataccataaatttacctatgttaagtgtacaattctttagtaaatgtataggatcgtgcaactatcaccacagtcccattttagaatattttcatcacaccataaaatcccctatgcccatgtacaattgattcctatttccacttccagtcccaggcaattgctaatctgatttctgtctctatggccttgccttttctccataacttaataaatacgaatagaatcatacaatatgtagtcttctacgtcttatttctctcatttagcataatgttttggagcttcatgctgcagattgtagcagtagtttatttcttttgttactgaataatattctattgcatagatataccacatattgtttacccattcaccaattggttgataaacatttggatggtttttatgttttggcgattataaataatgcttctatgaacagtttaattcaagtttttgtgtggaaatgtcttatttcttttggatagataggtagaaatggaataactagatgaatggtacttttatgtttacctttttaaggaactaccagactgtgtctcagagtgactgtaccattttacctttccaacagcaatgtatgatggttccagtttttccacattctttcaaacactggttgtctgtcttttgtctgatggccgttataatgggtgtgtgtgatagtttctcattgttgctgtaatttatattttcttttttttatttttattttattttattattattacactttaagttttagggtacatgtacacaatgtgcaggttagttacatatgtatacatgtgccatgctggtgtgctgtacccattaactcgtcatttagcattaggtgtatctcctaatgctatccctcccctctccccctaccccacaacagtccccagagtgtgatgttccccttcctgtgtccatgtattctcattggttcaattcccacctatgggtgagaacatgcggtgtttggttttttgtccttgcgatagtttgctgagaatgatggtttccagcttcatccatgtccctacaaaggacatgaactcatccattttttatggctgcatagtattccatggtgtatatgtgccacattttcttaatccagtctatcattgttggacatttgggttggttccgagtctttgctattgtgaatagtgccgcaataaacatatgtgtgcatgtgtctttatagcagcatgatttataatcctttgggtatatacccagtaatgggatggctgggtcaaatggtatttctagttctagatccctgaggaatcgccacagtgacttctacaatggttgaactggattacagtcccaccaacagtgtaaaagtgttcctatttctccacatcctctccagcacctgttgtttcctgactttttaatgactgccattttaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgttagtttttttcttgtaaatttgtttgagttcattgtagattctggatattagccctttgtcagatgagtaggctgcaaaaattttctcccattttgtaggttgcctgttcactgtgatggtagtttcttttgctgtgcagaagctctttagtttaattagatcccatttgccaattttggcttttgttgccattgctttggtgttttagacatgaagtccttgcccatgcctatgtcctgaatggtaatgcctaggttttcttctaggttttttatggttttaggtctaacatttaagtctttaatccatcttgaactgatttttgtataaggtgtaaggaagggatccagtttcagctttctacatatggctagccagtttacccagcaccatttattagagagggaatcctttccccattgcttgtttttctcaggtttgtcaaagatcagacagttgtagatatgcggcgttatttctgagggctctgttctgttccattgatctatatctctgttttggtaccagtaccatgctgttttggttactgtagccttgtagtatagtttgaagtcaggtagggtgatgcctccagctttgttcttttggcttaggattgacttggtgatgcgggctcttttttggttccatatgaactttaaagtagttttttccaattctgtgaagaaagtcattggtaacttgatggggatggcattgaatctataaattaccttgggcagtatggccattttcacgatattgattcttcctacccatgagcatggaatgttcttccatttgtttgtatcggagtcttaacatttgttgaaatgttcttccatttatttgagacagagtcttgctctgttacccaggctggagtgcagtggcgtgatctcggctaactgcagctctgccttccgggttcacggcattctcctgcctccgcctcctaagaagctgggactacaggcgcccaccactgcgcctggctaattttttttgtatttttagtagagacggggtttcaccgtggtctcgatctcctgacctcatgatccacccgccttggcctcccaaagtgctgggattacaggcgtgagccaccgcgctcgaccttaaattcttttttttaagaaatacctattgaaaaaccattatgtgtctagtatggtattagaagcaatgaattagatgacaagatctcagacctcatgaagttggcagcctatttgggggcaagcagtaaagccagtaaacaaataattaaataagacatgtttcaattatgataaaagctgtggaagaaataaatcaggagatgtggtgtacaacgactcagaatactggtaattatgtattaatgctttggtgaaattggaatgactcaaatcagtgtgtcttccaagggagtgagaatactggaggggaatgcccctgttggctatacaggtataaatatcagaataaacataagggcaagcgtataaacatcagaatcacctaggtttatgattttgtagctgcacatttaactatctagagagcttttctaaaaagtactgatgctagggtcctacccctagagattctgattcagctgatctgtagtagagccaaggaataagcattctgaaagccctctgggtaattataatatgcagccacaagttgagaactattgatcttgagcaaccctccattgagattctgagatgactgttcactgccctcacttgaagaatcagtgatggagaagccactatgattggtgagagattaccgtatctctcagatgaggagtgctggaaacaaagtttgaaaattaccttgataaaataggtctctgatcctttcacaagtctcatatggtcattgtccaaagctgccctgtcagagccactcttgctggcctcccagacactgtcacctccccttttctgctgtgtgtccgtctcccagcttccatgtgctttgatgtaaatggcttccaggtgtgacctgctgtgggatgttgccattaagatgccagagccgccttgtctgaccctcacacaaagttaggagtgccttagagtttatgtctctctggtgcagacatagccaataactgaccagcactggaggttcaaaagcctttggtttgagatgagacaaatgctgggggtataatttatgctccagagctccctatgagatcaggctaagactgggactttgcctgatatcacacccttgctccacttcctcccattttctctcactcctttactagtttcttctgggactacttcctcaatacatcatttgcagtgaaactttggctcagggtctgtttctggaagaacctgaactcagacatgcctccttctgggagaacgtggactaaaatatgcatctttctgaagttgggcaatctgtacctgtgagctaaagcatacactccatctgtcacctgacttcaactttctgaaaggatacacctcctagctagaaacttttctagatatagaaagagggccacaggaactgttactgatggaaggaggctctgataggtccctggtccccctcagtggaatctggtccgagaatctcaagccaccatttaaaccattagcttagggtccagagggaggaagatggtcaagcagcaggcttttccaaagcctatggagaggttctgagggtttttgccttggatggacagcaggagatactgaaagtaagagtacaaactctccttgaccttacagaagtcaccttagagtgaatgaaattagttgggggcacagtataactcttagatccttgcaataagagatccttggcataagtaatgaaaaaacaggtcataaatgcccatcttctcattggaagaaacagagagggtgtcacaagaggagaaaatgtatgagtaaatgctatgtgctgtgtggtgagtgtcttaggttattcttctctcatgttattgggatttttcctactaaaaaaatcctttctctttaaaaatgattctgaatagattattgcaaccactgtttttgagctggagatatgaccccaaaagggaggtcattcacatttggatatgattttatcattaccagcaagctgaaaagaacatgctcttagataaatgtattctcaagagaatgagaatgaagctattgcaagaaatacaaataatacccaatttcttgtttctttcccccaccctttcctaaaaagtgtcaggaaaggaaagttatacaacttgtgagtgctgtttcttctctccacctcttcaatcagagttctgtggtctttgagagaggctgaatccactggcaaacagatttatctaacaaaatgatttaaatttttctggctgcattgcaggtttgcttttgaatggacaggctgtgaatgcatgggcctgaaggagttgctgggtatattttggcacaataatcacaatcgtatgtgaaccatatgttgactgcacagtttaaaccaaaaaaaaataccctttgctattctttgtaatttcatatggagttggttgggatagagctaagcagtttaggatgccaagttaaaaaaaaatgcttggaagcccctttatacgttttattggtttgtaggaagagaagaaaatagaaaaaaaaaaaaaaaggaaggatactgagctatgaatgaaaagtctgggtttctacttttgctgcagtttgaccctcatgaatcacttgacctctcggcctcagcctcctcatgtgtaatctggcttttgagcttggttgaattgacaagtggatcttcagtaatcagattggtggggagaaagagctgatggggatatacaggctgaccctcacagagatattatggctgtgtctaatagtccttggcagcatttgaatgttcagagcccagtgagaacccatcttcttgcttggccacaactatggaatcttatgctagttgtggacagtaaatgaggacagccatgtggttcctcttgatccatcccatcacgggagggccagagacagtaggaactgattcttggagggggattcagtcccagggaagctcccaaggcttcgggggtctcaatttagaggggaaagatgacagaaggatttaaggtagaatgggaagtctgtctgagaaagcaagacaaaggccttgttatgtagatgtgatcaattcaagcggtgattagggataggctggccctcagaagaaagcagggactcccagctctttccaactcctggtcctggggatgaggctattggttccttctaatctgctgaagaggatatgaggactgctttggttgcatgctcccaaatccaatgcagtgttcttaggtctgttgttagcttcagcaggagagcccaagaggttgtctgcttcatgaagctcttttgtgtttgccctttccctcacagatcagagtcccacaagtaatggaccctcaactggtcgagctactattagcattcaagccagattcaaagatttacctgaatatattgttatttataaagcagtgcaggtcctgaaaactctgttacaaacacccctccacttctgccctgcaacctctaggtttgggtattaggtccttgtgctatttttcagtgactgctttgagcttagctgtcctgataaacataggaattgtacagttgagaaggaccccagagttgaggaggaagtgattattgaaatcataatttaatttaaacgtttattgacttcaacaggcattatgaacatgcatagatggtgcacacccacacacaaactttggattgttaacaccttctcagatgttacacacacttatttagaagtctaaacactcaggttagccacgttcatctgaatgttatatttactcatttggagttagatgcccaggtaatacagatcctcacttggaaatggtacaccctcagatgtagtgtgcatttcttgagagattgtccacatccactcgcatgtcactcacatgcactctgaactgtcaggttcttactcagatgtgtatgtacaacaggcatggtcattgagctgctgtttacctgcactcatctaagtgtggcatatactcatatgcccagcgcttccttttcgcatgcctgaaaattcctatgctcaagaaaattcaggggaaaacttgccatattgagtgtgtcacattttcttagggcagttctccatagccttttttccttaatgaaatagtcctgtgtctctgtcatctcccaagttgtactccttaatcaagtgtctttagatggatagtctgattgaaggatggtagcctgcaacacgtttcatttttgataaaccacatgctggttcactatgccctgtttaaatgattggtttggggtcccctactgcaaccacctcattaattcacagaagtctccagtgggtactctttgggcaatcgatcttctgttttagatcatgagtcccagagatctgtgcaataaagctcttctaaaagaagagcatttattccagagaactataaactgtggggcattcaaagagattgaaaaatgttctccaacttacaaaccttaaaagaacttttacaaagagagtctaacattgggtatcagttgatattcaataaaggatcagtcatctctattcacacactagcatcttcttacatccttctaacttgaagggaacaatatgagatcactagacaggaactcaaggcaatcgctgtttatccgattagggtttctgcatccaggcagatttggtttcatgtttgctttcaattttaattcaatccaatttaattcatttgaacaagcattcattgatcacttgttgggtgacaggcatcctgctgggcagtatggggtgggggtggagaatgaggcagagataagtaagcaacaatgcctactttgtaaaaggtcacaatctagccagtgaaagagtagtcccatctcatgatattggaaaacaaagcagatggagattagatgagctctaggggaactaaagagggaggtaattcatccagactggacatatctggacaggcttcatagaggaagtgaaagacatgctcagcctttggaggaaaccagaggtggccaggatgcagggcattgcaggtagaggaagcataagtcagtaatgcatgaggtgagatccaaaagatgtctgtgcaatagcatggggtctggagtagctggaagatgggaacaccatgagaagaccttctaaatggaagacagaaggcaggcacagaggacttcaaatgccaagattaggagttcagattgtataatttggacaatggaaggcctatgaaagtgtttgaagagctatatgattaggaagccatatgattaggatgagtgattaataaatcaagtgccttagaggcaaagagactagttgaatctgggtaagtgggaaagtgtccaaccaaggcattatcagtggaaggagaaaagagaggtggggcagatgcaaacctgcagaagccaaatcaacagacttctgtaaggctgttgattaggatgaggagtgagaacgaaggagttaagaactgaggatgagccctagattcagattctggccacttgtcagatgctgctaccatttactaagaaaggaaatgtagaaggaggagcagacaggtttgtaggggttggggctaagttgagttttagatgtgtctagtgtgagctggctctgagacagctaagtggaggtaaagttctacaacgtggtaggtttgaaaatctgatgctcaggactggagttttgttgtagaccgaaccaatgcttccacataggagaagttgggttgacaccattagagctaacaagctcattcttccagaaagttgctcaaccatctgtgtctcctctttcctgtccagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagtaagtatggccacatggaggccattccttgccttgtttgcattttttcattctcaaatgataagtcagcagggctctagagcagaggatgaaaaactaaggcccgtggggcaaatcctacctcatgcctttaaattaaaaaaataatagtacagctatgcctgttcatttacatactgtctatggctgttttgatgcttaacagtaaagttgaacagttgtaacagagactatatgctccacaaagcctaagatatttattatatggctttttacataaaacctttgcacactcctgtattaaagtaaagagatggtgctttacttgaggaaattacatgacctctctgatccttaagttcttcatatataataataatatctatcaatttgctatctaggaatgcactaatcatggtttagttgattagtgattaatacgccctttttcattgccattggtcacattagaaaatagtgtttctccaaaaacaaggtaaccatttttttttttttttttttttttttttttgagacggagcctcgctctgtcgcccaggccggactgcggactgcagtggcgcaatctcggctcactgcaagctccgcttcccgggttcacgcaaggtaaccatttttgtgtcaaatatttctttggtcaaggattggcaccagtcataatattagaaaatcacagggctggaaagcatatcaaaggtcattcaacaatctcaaacacacacaaaacaatggttctatccatactacaacaccaattaactggcattagtgcttattcttgaatacctccaatgacagagaactcatttatctctgaggtagctttactgttttctggagtagggagtgggctgtgtctctaaggaggctttttaatgtacttactgaaatatttcctattgaagtttctatccattgttcttgattcacactcttagcatcctacaaaaccaatgcaaccaccttcttggtttatagtctttcagttacataagatcttttctaacacccttttcttctctatataaatgtgcccataagattgtcttttctgcaagctaaatatctttagcctgttttattacacaagtttgtattttccatcaaggtggtcatattttcatatttcttttcttttcttttcttttctttctttttttttttttttttttgacacagtctcactctgttgcccaggctggagtgcagtggtgcgatcttggctcactgcaagctccacctcccaggttcacgctcttctcctgcctcagcctcccgagtagctgggactacaggtgcccaccaccacacccagctaatttttttgtatttttggtagagacggggttttaccgtgttagccaggatggtctcggtctcctgacctcgtgatctgcccacctcagcctcccaaagtgctgggattacaggcgtgagccaccgtgcccagccccaaagtggtcatatttcttttaacaaacaccaacaaatgctaagccctacagttcatattaagtttatgtagtatgtaccctccaagagcttatagaaatgtaagggagtctgtcatgtgccttgttatgcagtgtataacatggagaactgagaagcttgctggagaagggaagcctgagacagaagcaagatttggtgaagtgtgtggggaacagcctgggcaggctctgggtggccaagattgagagtttaatctgtcaatggcagtcagtgcttggtgagaaacccggattgaggaactaattaacatttagaatgtccacatacccatttaaattccactgtggtatttcagttctgcatttattactggttcaagcaacactcctcacagagagcataagactacaaagagaagctgccagactgccttccacctgtccatctggtcttcccgctgcatgaagcactctgatgtattgagcaggaagacataaaaattggcagaagcatctgggactcatcttgttctcggttctcggcatcccacactggccagtttatcagttcagcacaaccctctaagaaggtgtggctttccctgctcttggcacatatcaaaagttgtggttgggtttccatgatgagatgggaaagaagtagctttactttattcttcccactaagatactcagaaaacctagaaatagagcatggctatagaacccgggaaaccaacaaatgcacatcagaaggaatgtcctcaccataagagtggttggccctgagccaaccacagaggttttgttacaggaaaggggtcctgatccagactccaagagagggttcttggatctcgtgtgagaaagaattcagggtaagtccgtatagtgaagtgaaagcaagtttattaagaaggtaaatgaacaaaagaatggctacttcatagacagagcatccctgagggctgctgtttgtccatttttatggctattccttgatatgctaaacaagggtggattattcatgcctcccctttttagaccatatagggtaacttcctgacattgccatggcatttgtaaactgtcctgatgatggtgggagtgtagcagtgaggtctaccagaggtcactctcatggccatcttagttttggtggattttagccagcttctttactgtaagctgtttttatagcaaggtctttgtggcctgtatcttgtaccgacttcctatctcatcctgtgagttagaatgccttaaccatctgggaatgcatctcagtaggtctcagcctcattttacccaggtcctatttaagatggagttgctcaggttcaaatgcctccgacagtttgctccccaaacatcatatcagagacctccctcttcaagactcagggatttgccatagaggaaaaaaaaaaaaaaaaaaaaggatctcactctgaaactgcctcatctcagaagcagttttgacactgcttcagaaatgaacaaggccatttaattacctgtgccttctattccacaccatgcatatgtactcttgctttgtaactaagattcccagtaacgaaacacaggcaggaatggaattggatgagtgcttatgccacatgtcttgcgggtgcacttgacctcacaggaacagacaggggaaaagcaatgggagctgggcactcagaaggctgtacttttctggcaaaggaaaaactacacactgtttcaaatgactgtctttagtattaaattttactgagaagagttgggtgaaagggtcattgaagcagaacagccattctcagtctaacaaatctctgcctggtccctctcaaatttttccatatcataaagggcagcagacaatgatgttaagcctggaggatttttgaggagaaagtgttataatccacaaattctttatcagccaagttgttgttcgtgtgcaaatacatcagaaagccattctcggtatccaggggctcccacgttccctgcttctaataaatcattcacagagcaattgactgagcaattaatcaaaataaagaaatcaagaattgagaaatgtggaatacgaagacctacagtgagcataaaactaattaaacatagcattaatgctcaataatggctctaagtgtgttacaaaatggaaggttaatgtaaaatgtaactacttaaggcaaagatgcataatgtaaaaacttaacagttctaatctggatctataattcactattttatcaacaaaaactaagacaaagttggaagatggatgaatgtaaataaaaatctgctcattttctcatgttagacaagagggaatacataattactgttttatttctgatactgagaatactaaaaagtatagttcttttaaacaaagtcagctctccaatctatacttaaaaagctgagaaacaacagtcaacgaagaaaaatgaagaaaataaagaaaactataagtaaacatgaaaatcaaaactataaaaaaagccagaagatgaaagcactagatttgatatggggtggcgggggggtaaaaaagtgttgttttgctccattgtgaaagagaaagaaaacagcttaggtcaaagaaaaatcagaattacccatatttctgtcactaaaagattaaagacaaaggatgagatagagttatattaacctcaagtgaaaggaaagcagaaatgggcatttgttgcaggatggttgtgagccaggtggaataatttactatcagcaaatttcattgctccctactctacctgcaagttttagtcaaggaagggtaggagaattctgaggtctggacatctttgttctacggatgttaaggatggtttgtcaggttaacagagtggctatgaattcaacctttactatcagactgcctaggtacaaaaccctagtagctgtgtgactttcagtaaactactaaaataattagatatgatggattaattaaggaaacatctgtcaagcacatgcaatatgtcaaaaaaggcatttttctgagtgctgagaatgcagcagtgagtcaagcaaagatccctgatctcatcgtgttttcattctagtgggggagagaacaaaaataaataagtgaaataatgtatcgaataatgaatccttaggtttcacattaggaatgtggaagtcagtcattaaatgtttactattatcagcatgaggataaagacattttatagactctttgttgatctgtgaatatgaagtattttaatccagccatgtgaacaccatgcagagttcaagtgtggcatgcactataagatatgttgctcagggttcttgcaggcattttcatgacacaagagttgttcacaggcacttgtgttgggaattttgttccaattagtaatctcacatttatccattgatgccttcttacagataaaaatgtagtcccatttgtcctggcacactgtctttggtgcctaattcacaacacctgtctcttatgaattagaccatgttgtaaccatttgttttggatatagcaatattatagaactatagcatcatagagtaggaaggactttgaagtgtcatctagtctagacgagaagccaaaaaaaaaatctccaataaagcattcttagcaacacattgtattgcttcagcttgatcaatgcaaattgctggagtgaaagggagttgattcctttgtggagcaggtaaaattgttaaagcttttttcccatatagagctaaattctgtctccttgactctccccttgtagccacttgtattggtttgaacaaatcaaaacgttctttcctttgttagcctttcagagaaaataagacagtaccaactaccctcctctggccactcaagttatttctcattgataattaacatgctattacttcttttatttttcacatggcataatttctgggtatccttcatcctacttacccttttctctgataggctcattttccccatcatgttctcctcaaaaagagttgcccagaacctatcactgttcttcagatatggttcagacatgcctgctagattttaactaagcctcgtgtcttgaacctttcctaagacattatttctcaaacattccaacatgtttttcactttggggtcttaattcagggtgcattttacctacatctgtcttttcttcactgtttgcagagctagtaccttctcatttttcaggcctgagtttcaatctcacatctccagagaagagtccaaccatattacctaagaaccacccaccagcactcactcatatgttaacccactatctttctatattacactagatatatatgtattttatttgcacatgttgttgggtactgcatgcctcccacagcatgctgagagctccaagagtgatgaattgtggttggtgtgtttgggttttttgtttttttagctgctatatcctccatgctgagtgtactatttaacacataatagacacctaataatcatttgatggattaatgaaagaatgagactatgaactgtttcttgttgtctatgaatctgtttcctcacttataaattgaaatagtaatatatacttcacacagtctgtttgaggattaaataagaaaaagatattgaataatgaaaagcaccaagtaggtgtcagtacagtctgaatttccattcagcgtagaatgagagatgttgtttgagccattttcaccatagataaaagagtcctaaaggaccttttttctccatcatagtagtaagatttttttccccagatgtctcatttcccaagctccaggctcctgggcagccttgatttcctccaaatcctccaaatggtacccagggtagctgtctcagttctaaacagcgggtgggtgcagtttcgcattgtttgtttcacactcttcccagaatgaggtctgctgaatctactgttctctgcatcctcaccaccattagccgtaattgtgaagttgaaaggaccataattaacggttggatgcaaaacaagtgtggcaaactcatgcaaatatccatcagaagccaccttttgttgggcaatgctgttatgcatgttctatttatgcagaggataaaagtcttttcttgtcatatcctttccatcatgtaggggtacatttaacctggatgatgcctctgccaaatgctaagctaaataagagaagtgggaagtagcagggtgattgttctctctctcctacttcctcctccagttcttgaactcaattgcctcttgagagcacttggaaaccagatgctgtgttgaattggtcatgatgcttgcagtataatcacgttataatagtggggattatctaggtagagctaggttagggaaaattctgtgtctctgaatgaattgggagaaattatattcacttgtgtccaaccactgttaaagaaatggttgcacatggatgggttttctgtggcatgatagagtggaaagaactgagagttgagcatcagacagacttggctttgaattttggctgctctcagctatgtgaacttgaacagtttacttaacatctcaagatggaaaatatgattaatgatctgcctcaaaaaaatcgggagagagtaaattagacaatgtatattaaagtatcttatcgcattacagttggactatttgttcttttttcttttggctgctttccagaggctcctcttctgagggggaagagggttggagcatccttacctggcatataccgatttgtccagtaaactccacatagaagcacacaccttcctaactttggaggactttaggacttgtgtctgtgtcccagctgatgaccgccttgactcacccatgactcaccccaggctgtattcctcttagtttaacttctcatacatggttttgtcactggaaaggggtccggatccagaccccaagagaggattcttggttcttgtggaagaaagaattctaggcaagtccacgcaagtttattaggaaagttaaggaataaaataatggctgctccatagacagagcagcagtatgagctgctggttggccatttttgtggttatttcttaatgatatgctaaaaaaaaaggggtggattattcatgagttttctgggaaaggggtgggcaattcccggaactgagggttcctcccactttcagaacatataggctaacttcttgatgttgtcatagcacttataaactgtcatggtgccggtagaagtggcttttagcatgctgatgcattataattcgcatataatgagcaggagaatgaccagccgtcacttttgtcaccatcttgcttttggtgggatttggccggcttctttactgcaacctgtttcatcaacaacatcttcatgacctgtatctcatgccaacctcctgtttcttcctgtgacttagaatgcctaacctcctgagaatacagcccagtaggtctcagccttattttacccagcccctattcaagatggagttgctctggttcaaaggtctctgacagtttcaagcctgatatctgttcctgttgagtcttttggcacaattgatcttatcttttggttatgatattgccctttctaccccatttcttatttctcgtgttagttcagtgactgttcgcatgtccttatgaaaacctcagatagacatggaatgagaagctgtagatataagctctagagggttcgagttaagatcatcaggagatcacatggcagtttgggtcttggataccccatcaggaagtttatttgaaaactcctatattggttaagataagctaaattattctgtagtaacaacaacaaaatctcactggatcacttctgctatatatttgaaatgggtcagcagagggtctctgcttgttgcaggcagagactcaggccaacagaatgtccatcttgacaccaccaccaagtctgagaaagaaaaatgtggcaaatagagcattcgttctacaagtttccatacaaagtggtgcatagcattttcacattccactggccaaggctaaccacatggccacacttaatttcagaaagaataaggcagtgccttctatatgcctaggagaactggaatatttgagaacttccccaatgactaccacaattttccatgatgactaagcctccccttcatattcttataatacccagacttgctcctgaagcacctgggcagttcataccacaaatcctgaggaatttcaattgcttgagcatctgctgtgtctcagatattaagcaaggtgctttcacctatgctgcttccttgattggtctcacaaagtgactacattttttcagtagatggacgaacacctagaggcccctggaatcccatggggtctcagttacttcacactgaaggagggattttagtaacagcttttcccctttacctccatggaggaatggtaaagaaatgcctgaaactcaatgtgctgctgttccaccctgaaaagcaacggtcttccaatgcttctataactcagcagaccttagacctgtaccacccatcggtagctgagccaaggcaacagagagctgtgacccagaggcccccacgtaaccgtttgctgacttgtcactatagtctatgtaaggaatcgattcctggattttattagctctgcagagccctgttgaagtggagaggaagactgaactagacactttgattccaggattatcatcacaacctttccattactccttaggaaaatctcaatcgggtaaacatccactcacagctcttgtctgtcaccagagcctaggttccatgccccatttatctgcctagaactctttcccagtcctcagtggactccatctcctggggcttacccactcacttgggcatccctgcttccaggcctccattccattgtttgagccttaaaactctaaacccctgctggagctctgttggggcccagacttctctccttaggtaagatagaaattccccaagtgtcaccttgtacagataccaagatgagctctcccaggttgctaatttattttttcatccacttacagtttctacagattttattatcatggtatgagacctgagggagcaagaacattttccttcccatgcaaatatactttaaattcatttggaaagggagatgaaggttacccaaatgttgacagctgataatcttgtcagcctgggccttcagggataaatgctccagactccagtcccaacaaagttcatggaaatagcagcctcagtttctatatagcagcatctctgcctccatcaggcccctacaatgtaaggaacctcgtgaagcttggactgattgccctcagatggtgaaaaagtagagaaacttctgaatttggaaatggtatccatgggttttagaactggcttttccgtttcttagctccatagacagaatacttgcctgccaaacctcagtttcccctctgtcaaacagggatgagatgtgtccttcaagctcactaggacctttgtaacaagtaaatggtaggcgtgataactctttgcaaaggacctttcaggtaaaggtatacttgctaaaacacacacacacacatacacgcacacacacacgtgcacacacatgttaaaactgatactcaattcagttattggaaaactttgaagtatctttggtggaaacacttgggtatgtgaatctaaatttttaactgtaaattttatgaaatttatatacagaacaagaattcagcatatgtgcatatacacataaatattttagcatgcatatatatagatgtatgtgtatatatgagtatgtatgtatacatgttcaattaaaattttttttttttacttttattttattttttgagacagagtcacactctgttgcccaggctagattgcagtggcatgatctcagctcactacaacctctgcctcccaggttcgagtgattctcctgcctcagcctcccaagtagctgggactacaggcatgcatcaacatgcctggctaatttttgtatttttagcagagatgggttttcaccatgttgaccaagctggtctcgaactgctgacctcaagcaatcctcctgcctcagcctcccaaagtgctgggattacaagcaggagccactgcaccaggccctaaaataaaaagtttaaattagtctaagaatcttatagtggaataaagagtaatcattgcaccagaggcctagtataggtggttagcgcagggtacactatctgtatctcctgagcttcctcgaagccaaggaaaaaaagagcaggtggcaggtttgcatagcttctcttacttgaaggaagcatacatatttttcatgaaagacactaagagggtgatttatcacatatatccttgtataagaagccctgagttgatgctggtcaatgtcatcagaacatttttgctcaaacactcaattagtccctcttatatcaatcctatgaaatctgaggttaaaatataaaaagttaatggagacatttgcactcacggattctatttcttgcactataaaatggcattaatgctattaaataagattagtgaatttccaagtttgtttcacctcagcatttttgattaatatgtctagcatggggtctttcctgttgcatagattgtcactgaccagctacatgaccttaggcaagtgacttaggctctctgagtctcttcttcttttggaaaacattaacacccatagtatcaactttataagaatgtttctaaatattaaataataagatgaataaaacacttatcacggggcttggcatgcaataaacatccaattaatgtcagatattgctattacatatcacaggtgggatagagcatagaggtacactcaggaaagaacaagcagaatccacaggggcagagtttttaaacccatggatcaaatttgaatagagtatgaacatgacgtgggatcagggaattcaggaggaggaaaaaaattagtgaagtccagggtttccagagacggcagctgacacactggctgcctgaaagaaagagagggattgagatgtcaaaggaagtttgggaatgtcgtacttacggagaggcaagtggagaagtgggacaattcttctgcagtccctttcctcctagaggctgaattttcatcaagtgtcatcttttacatcatggtcctcaagtttgcaaacccataaatgcaatttattgggctacacagttgaagagattgacatgaaccatatgtacaagacactgatgaaaatagtaggcaatgattcattcatctccttcaaagttattcctgcatctttcctatcagcaaagtctgggtttcctgctatacatcaccttctatattcagccatcaccaagttctctttgttctacactctgaagctctctctaatccatgcacttttctcatctccagtgccaccatcgtagttctggatagtaacatcttctgcctggacaacctcaacagtctcctaacgcttcttcccacatccacgattgcttgtctcaaacagattctcgaatcacagcaagtgtaaattggcactatatgtattctcatttaacacacaagcaagccaaggctgtgagaggctatgatttgctgaagcatactccagaaacaagagaacgagctggggttgaatctgtgcatgtgaaaaatgcagttaaaagtcctatgcatttactgctccgtttcatgccgagccctagtcccacaagatagcttcatagaggaatatgggtgcactagaaccaggagggtcccaaatcccttatgcactcatatttttcttttcctcccgccaaacatggccagcctaagtccctcagtcaatcttgaaacacctgctggccctgccattaacatcaacaaatagtgaggagctgtactaataacaattatcataataaattggcctttgattacatctgtcacctgagaatttcaaagactttacaaacatcaattagtaattacagctcaatggatctcttacagagcaggaatcattaaggtcagataagagctgcgcagggaagcatgaaggactgctctggtttgggttggtttaaaccagggggttgccagctcctaatagaaagtctaagtccctcttcatgaggtgcagagaaactacatttccaacttctcaattaggggatagtttgtacacagcctcaaagtcctattgttgaggaatgggaagtataaaatgcagtattggaagggagcttattgattgtccagttctcttctttcagcagataaaaggaaactgaagtccagtatggggaagttatttgctcaagatcagagccatggcttaaacccagtctcccacaccccatttgcatttgtttactctgcagaattgtgccttcattggtcatgagctcctctgtaaggagatatgaatgatgatgataaaaccccaaaaacccaccaattatttattatgggcttgttgtgagtcagttgggaatacagataaataagttacagttcctgccctcagcgaacccacaatccagtggagaagacagccatgaagacaaatgtgggcaataaattatcagcaatcccagtggcagaatacctggtgtgttcagctataaacctggaggtagaggggatgaggaggtgcctaggaaaatcttgtagaagaagtgacatttgacttggctattagaaggtaagtggatattttccaggtagacagtggggcagaggaaagtgtatgttttgcaaaggaagcacctgagcagaagccccaaaattggggattccctgatacatttgggaagacaatcccggtgttggttccgggatatggaatgaagcccagagagaggcagatatcaaataatgctgggctttgtatgccatgctaaaatacttggcatttattctgttgaaaacagggaaaagaaaaaaaaattgtcttgcctataatctcaatatcaatttattagaatcataaagtcatgcatatatatttgcatccttaaggcacttgtgctcacaaaattttgtttaccctagagagttgtacagagggtattgctcccattctacagatgagaacactgtaagtcaaaaaaaataaggaatgtacccaatgtcactcatgttgggaaaaacaaaatttgaatgtctcaattttttattgatgacatactccatatgtattgttctcacctttaaaacacacgttgttagctaagaaacgtttcacacatacaaaagtcaagatgataacagactgatctgtatgtgcccgtcactcagcttcaacaatgatcatcaacccatcgtcaaatttgtttttgttccaacttactttctcttccaccaatatgtctaactcctttttttcaaggtagtttcaaatgcacagagatgtttcaagaatagtgtaaagaatgttaataagctctctatacagattccctaattgctaacagtttaccacaatagatttaccatcccattttctctctctccctctcctgttctttctcttcttcccctatttgtctgtttgtctatctatctgtctataaatcacccctttactcctaaatgctttaatgcgcaatttccaacataactacaatacaattaccaggaaattaatgtccacataatactactagcctcagttttgccaattgtctcagtcatatactttttagtaaatttaaacaataacaaaaaaaaacctggtccagggtcacatgttgcctttagttgtcaggtccctttagagttctcatatctgtcttgccttgacttttatgcccttgactcttaaaaattacagaccagttattttttagaatgtccctcaagttgggtttgtctgaggttttctcaagattagattcaagttatgcatttttgtcaggaataccacaaaagtgatgttgcttccttctcaatgtgtcatactaggtggcacatgatatcagtttgttccattactggtgacattaactttgattacttaaactgttgtccattaaggttttctccactataaagctactatttctttgtaatatataagtgttttgtacacacatatttctagactatgtaaaatcttcttcaaactttcatcttttagcatttgctgatattttttgttgaaatcaactattacaaagatgtttgccattaggtatatctcccaatgctatccctcccccttccccccaccccacaacagaccccagagtgtgatgttccccttcctgtgtccatgtgttctcattgttcaattcccacctataagtgagaatatgcggtgtttggttttttgttcttgcgatattttactgagaatgatgatttccaatttcatccatgtaccctaaaacttaaagtataataataataaataataataataataataataatacaaataaaaagatgtttgccaaatgacaattttctaattccatcatttgttccacatttattagtggacatctattccgaggatgagttctcctttctcccctattttcaatgtattaatttatttatattgataaaaatttatagattcttcttttattcagttggttatacttcagtactatcatcatttacttttatgctcaaattgtcccagaattagctagtgtgagccccttcaagatggttcttttgtcattctgaaatgtctccagcagttcttgaaaacttattttctttctgacagaatcttgtgcttcctttgccccagctctggttcctttaaatggggaatggtacttattatagaaactcagacctgggaacgagtgggaatcattgttagtgagtaccactgattctaggctctttgtctatgtatccctctacctgtctatccatctatctttctgtctatttttttttttttttttttttttgagacggagttttgctcttttgcccaggccggagtacaatggcgtgatcttggctcactacaacctctgcctcccaggttcaagtgattctcctgcctcagcctcctgagtagctgggattacaggcaccggccatcatgcccagctaatttttttatttttagtagagacggggtttcaccatgttggccaggctggtctcaaacacctgacctcaggtgatccacctgcctcagcctcccaaagtgttgggattacaggcatgagccgccacacccagcctttagctatctatcataaaaggcaaaagtggccgggtgcggtggctcacgcctgtaatcccagcactttgggagactgaggcaaatggatcatgaggtcaagagatcgagaccattttggccaacatggtgaaaccccatctctactaaaaatacaaaaaattagctgggcgtggtggtgcatgcctgtagtcccagctactcgggaggctgaggcaggagaatcgcttgaaaccagaaggcggaggctgcagtgagatgagatagcgccactgcactccagcctgggcaacgagagtgaaactgtgtctcaaaaaaaaaaaaaaaaaaaaaaaggcaaaagttcatgatacctccattctagtccaacatcaaggagtttattccagccttcactcttcccatttctgtaattcccttctctgacagtgagaagcttaacttcattattattcatatatttacttattgttcaacatagaatactcaagaagtatttccagaaatattaatcttagcaaaacaaacctactaactagggttcaatatatattttctgttctctcttcagtctaaatatatgcaaaccgttgtgttgaaaattatttggtttattttttttctttcactagaatatggttatgtatttattggaaattaagttaggtttgtttatgactctttgtttttaattttagtttcattttgcccatccctgttgatttcttaatatgtaaaacattataacgtggttctaaaaacattataacgtggttctaaaagcctagctgtacaaacaagtgcatacagaaaagcacatatcacttcttttacatcacctctaccatcccctgttggaaaccaatgtcattaatttcttggcggtttttttttgtgaaaattttgaagtcaatgtatgttatatttccccttcttatagaaaagctaacatactatagatacttgggtatcactttatattatttcataaatgtcttccttattttttttttacagctgcacagtactctttgttttgttttgttttgtttttttgagacagagtcttgctgtgtcaccaggctagagtgcagtggcatgatcttggctcaactgcaacctccccctcctgggttccagccattctcctggctcagcctctcaagtggctgggattaaaggcacccaccaccatgcccagctaatttttgtatttttagtagagacagggtttaaccatgttggccaggatggtctctatctcctgacctcatgatcagcccgcctcagcctcccaaagtgctgggattacaggcgtgagccaccgcgcccggcacagtactctattatgtgattatagctgtttatttggccactctcatgtgtggctatattgttttcaatatctttcagttgcaaatgttgctgcatcaaggaacttgtgcacatatatttttgtattgttgaaggtgcgtcttcagagtgaattcctagaagaggaattgtaggattaaagggtggactaatacacagttttgctagatgtcactaaatttccttccttaagggtaaaaccaacttgcatttgtcccagcaatgtatgactgtttcctcacagccttgtaaacagtttgtgtggtctaactttcatttttgtcacacttacatgtaagaaattatatctcaatatagctttaatttcctttttcttataagtgaaattgctatattctcctatacttaatagccatttttatgtaatttttgaattacctgtttatgtcttttgctcaattttcagtttgttttttactttttctatcaatttttaaagttatttatatatcagagatatcagtactttatctgtgatatatgttgcagttttttccagtttgtgatttatctgttgactttgcttatatttttgccacagcaaataaaatgttgtcagatgaatcattttttttcttttattacatttaaactttgaatcacagttaaaaagttttttcttacactcaggctataaaggaatttacccatgtttgcttctaagtcttatgtattttagtatttttatatttagttttctgatgtttggtctttgtttttgtgtgtgatgtaaattatggatctaatttttatctgttttcccaaatgtctgtctagttgtcttagcaacatgtatttaaaagtccatttttgtcccgataatttgagatgctgcttttctcatattttaaattttcatatgttcttgggtgtttttctggatgtcgtattctatcccaccagtctatgtggctatttacgcagcagccccacactgttataattatgggatctaaactttaatgtctgcgagggaaagttccccatcgagatttcctttttcagtgagtttctagctcttcttgcatgttccctataaattttagtgtccacttgtccagattcataaaaagtctattagtaattctgggattgcgttaaatttatacattaattagagtgaaatgacatctttaagatgttgaattatcttacctgagataagggatgtctttctatttgttcgagtctacattatctttcatgggtgctgtaaagttttctttatacaggttttgtgtgttcttgctattagcaagtatttcatctttgttgccattgtaatggggttttgctacccttatgtcctctgagtattggttttatatatgactactattgactttgtaaatacattatgtttttgggggcatagatgtttatacctattatattctttgttagctgtggattttagcaataaaaagtatcctttgccatgtgtaatacttttttagttgaattcttgttttatatcaggatcactactatatctttattattttttcatttactgtttatagcttatttcattccttcctttttacttttctgaagaaaattattttgttcacctttttttgaaattttttaaatttgtatttttgagggtacatagtaggatatatttatatatttctttgtttatggggtaaatgagacattttgatacaggcatgtgatatgaaataagtacatcattgagaatggggtatccatcccctcaagcatttatcctttgagttacaaacaatccagttacactctgttattttaaaatgtacaaataaattattattgactatgtttgttgtagcactgtttacaataacaatgttttagatgtgacttttatacatagaaggtagttgggtcttgtcttgtaatccaaatgaatatcttctacatttcagtacttgagttaaatcattaacatttggtgatatgactgagatatctcaactctgccatatatttttatgtcataatttactatattaattttataatactttctggtgtgctttctttactcttttattttaaaatttcatttggtatttaggaagtcttgtatttctgttctagtagttacctttgttcttttatattatttaacactttttttttttttttgagacagagtctcgctgtgttacccaggctggagtgcagtggtgtgatctcagctcactgcaaaccgtgcctcccaggttcaagcaattctcctgccttagcttcctgagtagctgggattacaggcacgtgccaccacacccagcttatatttgtatttttagtaaagacggggtttcactgtgttggtcgggctggtctcgaactcctgacctcatgatttgcttgcctcagcctcccaaagtgctgggattacaggcgtaagccagggcacctggcctatttagcactcttaatcccatcttttcttgtttaatcttttgctatctggtttgtcagatttttctggtatccattaactttcacatattgcctatattagttcgttctcacactgctataaagatattacctgagactgggtaatttataaagaaaagatatttgtttgactcacagttccacatggctggggaggcctcaggaaacttacagtcatggcggaaggagaagcaaacatgtccttcacaaggtggcagaagagagacgtgcgaagcaaaggaactagagccccttataaaaccatctgatctcatgaaaactcactatgacaagaatagcatgtgggaaccacccctatgatccaatcacctcccacaaggtccctcccccaacacatggggattacaattcaagatgagatttgggtggagacacaaagccagaccatagcactgcctgtacaacaataaatgacctaatactactcttctctttccctatttcttcctctttctctctctctctctctcaatttttagttgtattatttctgcaatgacagaaaacataacatttatatatcctactttcatccaacccctaccttatttcagtcttagatttacagttaaacatattaaacttttacccatcagtccttttgctgaagtttcctcagtcgtattttttggatgaacttatcttctgtagatccttcaagaaagacaagtacagcatgccctggctttttgaatgttgaaagctacttttccatagctttgctatatgaaaaacacatggctagctatgaagtccttggttaatattaatactttctctgagcttttggaaaatgctgccacattgttttcttgctttgcatgctgtttttgagaagtatcatgatagtctaattctcttgcatgtgtacattattcaatctctttggctttgagagtatttattctaagtttaatagtttactaggctgtgtcttggagttgatcttttcaggtgcattttccccagggtactgtgcactctttcagtatagaggcttgggacttcttttacttccaataatttttcttgggttattgtcataaaatatttacctacctattttgtctctctgctcagaaatttcactatatatatgttggattttctttgccttacttttaaaccactttttcaccaatccttgttaattttttctatatctcatttctgttgtctttgttgggtttctgtctttctttagtgccccttattaaattgctgtttttgacatctggtaatttaatcttcatttctgaggtgatcttttaaaaatttctctcctgagttaaatcaactttctttttattttttcctgatcttttgtatattttggtttttcacttgtgcttctgtaagtcaaagttgtttgaggatatttaattcagtttgtaatattacttctagactgttttcttgttaggggtagattttcatcatttgtggtgttttgacattttctgttttcttcatctagtagctttattaggctctttcaaattttaaaaaattttttagatttaaagtggcttatacgattctcagttcagaaacagtttgttctgactggatagtaaagtacaggtatttttttcagtcgatgattttgtgtgtatgtcatagggaatgggtgtaggttctgactttttgtttttattctagcttttgtgattctaaaaattcccactttgcttccttttttccttcaatctccaatcttccaagagtacttctcccttctttttatctcattttcacccattgaacctatttcacctgttgaacactaccaccttgagtcacatgttctttcaagtccttttcctgtactcttagttttgatctaccaggaattgttttagcactttcatgtgtagtgtggtctttgtctttctggaaagtattttagatcagccatgtactctctgctagcttacctcttttctcttccaaattgtttttacatagctcttgttctccacataggatgacaagggtgattgtgttgaaagctttagagatatttcatttatatctggttcttctttttgtaccaaacaggcctatgacattttaagacttctctatacattaattatgctgaaattgtggattttgtacaattttatttttttcttcttttcctgtgttgtttttgaatcatatgtgggaaaatttggtgttaaatagttaccaatttcttcaactacccagatccaacatgaattaatggttgattgactgtgggaagtcacatatctagaaaaatcaataatgactcctaggttgtttgcttaatcaactaagtagatgatggtgacatttatttaaacatggaaaattagtggtgagtaaggcttggagtgaaaataaaagagaaaacaattcttttagatgattgtatatttgattgtgagtatttcaggtagacagatggatagatgagcctggatctcaggaatatcaatgctagaaaaagtactttgggagtcatgagaacataatattcaaatccttgcaatttattataatctcctaaaaaagttaggatacaaatgatgaaagaggatataaaaccaagctccaggtcactccagtgtgttgaagtcaagtaaaggataaatacataggcaaagaaagggataaagaacaggtagtgaagtaggagaaaagtctggaaggtagaatgacttaaagccaagataattaaacaggtcaaggagggaatggtcagttgcagctaatgttgatgagagattaaggaagatggagttgtagcagtgactatgagtgctgaccatataaaagtcttagtggacttagtgtagtctcactgaagggagttccagagacttggagagttgaggcaatggagtcagcaagtagagataaaacttacaagaagattttcagaggttgggtttgattttaaattttccgaatggcttgcatgctacttgggggcttcctttcttagagtatggctcatggccttggctattgcctcaagtggagcctaatgccttccaggaagatctcataaagttgatagtgaacatttgtccagttagaagtgtctgtaaccaatagccacctatcctgcaacctgaggctgcaccttgccactcactgttggtgactgagggtctgcagaatccagcatacgtgctttctagtgagctagcactcaagtgccccactgcttctgttacccctttaaaggcattcctcatgcattatcctttgaggaggaggctaccacattacgtagtcctaatggttctgagttactcaaggattccagatcttatctgattgttcaaggtcctgcgtcaagtcaaacagaattttgtaatatcacaaaccacttagcctgttttccaaagaaagctgtgccccattgtctttgtgtgcctgcctgcaacccaagaaagcatagcatctgacctcaatgacaaaggggtatttgccttacagacacctcagaaaagaaggccacttgcttgaagtttactttgtattttagcctggcttattatacgtgtaaccttgaaaaatgttatttaatcttgtgagaaaaaaatggacattgtcgtatccacctcacagtcttgttataaggattaaaagacataaactatgctaagtaggtatgagacaagagaatcactggaacccaagaggcagaggttgcaatgagccaagattgagccattgcactccagcctgggcaaaaagagcaaaactctgtttcaaaaagaaaaaagaaaagaggacatcttttaaaaaaaaaaaaaaattcttagtgcttctttcaggtaacaaacatgttaagtgagtgagtcccattggggctaaacaatagcttaagggtcagtgcaatggaagaaagtcaaggagagtcagtttgtgggaaggctagactaaggacccaacgctgtcaataccataagcccaggctgatccgtatgcgtgaggtggggtgggatggtgggagggagctctagagtcaaacagagcaaaaatatgctttccaaaggtagggaaaggttgaggtaggatcactgcagccactcttctggtctaaggcaccaccatctcatcattcgactataccaccaccttcttctcaccaacttgtttctcttgcaccgtaagtctattctctatgtaacagcctctacctttaaaaattttaaacctgaaatttcaattcttcctgcctaaatagctctttaatgacttcctgttgttcttaaaatatagaccaaaactctatagtcccaaaaggtctcctggtcttatgtcgctagcttcgttttacatcatgcctcaggtaattcattatgatgatagccatgccagaattttgtatgtcttcaacagcaccatgcattttcccactttcaggcctttgcatgtctgtgtctgagtctgggatgaccttcctgatgcttcctgtgtctaacttctaaggttaaatggtctttctaaaagcagcagaccatctcccttcccacccacaccccatgccatctcccttacacatgcacagcacctggcacttctcacttactttagtgtactaaacttttaaacacaacctcatttagtttactgtactaaacttaaatatagattgacaaatttttcaccaagtaaatacatacctatgtgtgtttattgcatatctcccagtgtttattgcaacttttaattagatacttgtttgtgagaatggttgtctaatgtttgtctctccccaggtctgcatgctctatgaggacagggaccatgtctactttggttgtatttgtagctccagtacctagcccaatgtgtggcacatagtaatcattcaataaatatctgttgagcagttgaccaaatgagtacatgaacaaaaattaggtagactttcaggatctcagcacagtcttagaggagaattaaggcctgagtcaaagttactggggaaactatggaaagacgctgaggtcaggtctaaattccatcatatcaactgggaagctcagtcttagacaaaataaagacacaagttgggataatgtgaaaactatttgaaaactatgggatcagggttaaatctacatcctattaaatgaggagtctaatagagcagtaaagtaagaattgtatgtattagccaggtacctagggcttcttgatcaggttagcagcctaacccaagtctttctggatgataaacagcagctatgagacatttgatgacctaaacagttccactgtgaactcctcaattgaagaggcatcctaaaatttcagtaaataattgaaggatggatggatggatggttagatgagtcagacttgacctagtgttaaaatggaggctataagtagatacagatatgaggcattttgagtaataaggtaggtaacagcctaccaaaataaataaataaataaataaataaaattatttgcatgaaatgaggtattaggaagtagtatcaagaagactgagtactgaaagtaaaggagtactgccagtagctaaaaccagacgcagcattgaggactggaagcaaccttggtagagtggcctgcctattctaccaaagtggccttttctaccccattctccatcatttgattgatggggaaattgagccacagaaagggacagagagttacccaatattgctgcactggccgagccttgagtagaagcatttctcaacagagcacaacagtaaggacacggtgttctaccccagggtgatttatacctgcatgcagattttaatctggagtgggaagtggagcatgggtgagattaaaatgataaggaaatgaaattatattgtactgtcccagaatatattacaaacctggaattagggtatagtagagatcaaatagaaaatacagcttttttttccattccccagagacttatataatccgagaacaaagaaagtgctcatttctttttgttgaaaagactgggcactttggacataggcacactggccacacctctcctctgataaatatcagagtatccagaatatacctgatttgcttgctgacaatctagtcactcagaaggtcaagagagtgacttagggctttgttattctgtacctaattctgaccaacagagacaaattggttatggaattaaagttgttaggaacttaggagaaaacaaacgttttggcatcacgtttgtcagtcaggaagacttaagcataatcgtatatacactctagatcatagaaaacagactttaaaacgtgtggtgctgaaggggtgattttaggaaatggctcattttcctgcacgaaactgtggaagggaagattaaggaaagttaaaaacttctcacaaatgacacaatgtacaagagaagatagaataaaccactgcactaatttacaatatcatcaacagagtattcccctttctctgcaaccttgccaacatctgttatttttttgactttttaataatagccattctgactggtatgagacagtatcttgttttgatttgcatttctccgatgattaacaatgctgagcattttttcatgtttgttggccacttatacgtcttcttttgagaaatgtctgtttgtgtcctttgcccactttttaatggggctatttgtttttttttcttgctgatttgttaaagtttcttacagattctggatactagtccactgtcagatgcatagtttacaaatattttctcctattctgtaggtttactctgttgatagttttgtttttgtttttcttttgctgtgcagaagctcttcagttaattaggttccaatagtcaattttcgtttgtgttgcatttgcttttgaggtctcagtcataaattatttgcttaggccaatgcccaggagagtatttcgtaggttttcttctaggatttttatagtttgaggtcttacatttaagtctttaatccattttgaattaatttttatatggtgagaggtagtgatccagtttcattcttctgcatatggttacctggttttcccagcatcgttttttgaatcgggtgtcctttctccattgtttatttttttcatctttgttgaagatcagttggttgtaggtgtgtggctttacttctgtccctgtggaaagcagtttggagacttcttaaagaactaaaaacataaccaccatttgacccagaaatcccattactgggtacatacccaaaagaaaagtaaccattctaacaaaaggagacatgcacttgtatgtctatcacagaactattcacaatagcaaagacatggaatcaacctaggtgcccgttagtggtgggttggataaagaaaacatggttcatatactccatggaatactatgcagccataaaaaagaataaaaccatgtcctctgcagcaacatggatgtacctggaagccattatcctaagaaaattagtgcagaaagagaaaatcaaatgccacatgttctgtcttgtaagtgagagctaaacattgggtacacatggacataaagatggaaacaatagacattggggactccacaagtggggaaagagggagagaggcaagggctgaaaaactacatattgggtactatgttcatttgttcactctttgggtgatgggttcaatagaagccctaacctcagcattccataatatattcatgtaacaaacctgcacaccaaccctctgaatcttaaaacaaaacaaaacaaaacaaaaaaactctgcagaattccctttattgtgaccacattttaagagaatattcccacagaaagcaaattaatgttcacatttgcagagaagaagtgaccagaagaagcatgagggaaacttctgaggtgctggcaatgttgagtgttttgatctgggtgctggtcataggtgtgtgtttacttggtgaaaaatttgtcaaactgtatttaagtttagtatactcatctgcatgtatattgcacttcaaattaattgtgcaagaattattaagatttagtctgtttccttcaggatgtattttttaaatgcttaaatttgcatgttgtaacaaaaaaatgtactttgctttatttatttaatattctcttatgtgtatcatcccatgttattacatggccctcacaatcatttttgttaacagctccataatattctactatgtagatagaccccagttttccttttggaattttttctttttatgtttttaacgtatactaattgtaaatatttatgggatacatagtgatgttttgagacatataatgaatagtgatcagatcaaggtaattagcatattcatcattttgaatatttaccatttctttgtgttgggaacattcagtatcctctgtctagctatttgaaactatatattttgcttaactatagtcatcctacagggctacagaacactagaacttattccttctatctaggtataatcttgtatccttcaacaaatctttccctttctctctctccacttcctaacctctagtatctgcttcctgctttttacctctatgagatcaacttattttagtttctgcatatgagtgagaacatgaagtatttaactttctgtttactgcttattttccttaatgtaatgtcctctagttccatttatgttgccacaaatgactggattttattctttttatggctgaatagtactccttgttgtatatataccacattttctttattcatctggttttggacacctagtttgattgcctgtcatggctattgtgaatagtgttgcaataagcatgatgcagatgtctcctcaatatattgatttatcttcctttggataaatgcccagtagtaagattgctggatcatataatagttctatttatagtttttttgaggaacctctgtactgttctccatagtggctgaactagtttacattcccatcaacaatgtataagagttcccttttctgcacatcctcagcagcatttgttattttttttgtaatagccatcttaacaagggtgagatgatacctcattgtagttttaattggcatgtccctgatgattagtgatattgagcattttttatatatttgttggccatttgtatatctccttttgagaaatgcctgttaagatcatttgcccatttttttagttggatttttatttgctgttgaattgtttgagttcctagtatgttgtgaatattaattccctgagggatgaatagtttgcagatactttccttccattttgtaggttgcctttgtactctgtttattgtttacttttctgtacataattttttagttttatataatcccacttgtttatttttgctttctttgcctatatgtttaaggtcttattcataaaatattttcctagatcagtgtcatatgtttggtttcagaccatttcccttatgttttcttctagtagttttatagtttcaagttttacatttatgtctcttatccattttgagttgatttttgtatagggtgagaggtggcggtctagtttcgttcttctgaatatggatgatccattttcttagcaccacttattgaagacactgtcctttccccagtgagtgttcttggtgactttatcaaaaatcagttgactgtagatatgtgcattaattttggcgtttttaaaaatattatttcattggtttatgtgtctgtttttatgccagtaccatgctgtttttgttattacagctttgtagtatattttaaagtctgttagtgtgaaacctctagctttgttctttttgctcaggactgttttggctatttgcggtcttttgagttttcatacaaattttaggacttctttctatttctataatgaatgccattggtattttgatagagattacattcaatctatagattgctttggagagtctgattattttaccaatattaattcttccaatccatgaccatgagatatctttctatttgtttcccttcaatttctttcaacagtatttttggtttttcttgtagaggtcttttacctccttggttaaattgatttctaggtattttattacttttggtagttattataaatgagattgccttattgatttcttttttaggtagtttattgttcatgtatagaaacagtactgatttttgtattttttaggtagtttattcatgtatagaaacattactgatttttgtatgttgattttgtattctgcaactttactgaatttgcttagcagttctaggagtgtttttttggtaaagtttttggtttttcgtatacataagatcatgtcatgtgcagacagagacagtttgacttttttttttccaatttggatgcccttaaatttttctcttgcccagttgctctggctaggacttgcagtgctgtgttgaataagagagaccacagctttctttgccatgcctgtgtggttagacagatatatcgctcatgattttcacttttataaagaacactggaaccaacatcattgaatataaagcttcatttatatttaaagttattccctgagaaaagattcttagatgtctggacagataagactgaatttctttaaagtgaagatacatatttagaaattactctcagcagtattagcctcatcaaacctttgccctctgctctattcaaaaatcatgcacagaactggcaagttttctaatatattactttcaaaatctttttttgttgttgttgcattaccatgaagtggaagatcattctaaccatctatagtctcctggcacctctcccagtctacacaatttctcaatgatagtcattgtgacactgtacaatcatttgcatgtcttcttcagtgttctgggtttcatgctttatttaaccgtctcaagctctttaaaccaaaacacagggtatggtgctattggaatggaagccaacagaagctgaaaacctttgtccaaacatgaaaacagaaatgagtttgctcactttaattgtcatatgcaagatttaacttgtaacttaagctttttgtacatcacatttagagcaatgtcctttactgttactttttttctcagccattttcctttttttttttttcatcttttgggtatgttctctgaaaaaactttgttattgaaatgtaacatgcttcaaattttgtgtgaagattttatatgaatgattcatatacttgaaccatgacttgtcatttttttaacatttccaaattatctactttataaaatgaaataattgtttgttttaaagagagacacttatagtttttatgaagaagaaaacacttgttccgaagaacaagtcatgtcaacccaaccttctttctttaagacagtctttgcactgattggagaaatgcaatagacagagtatcagtgtctaaaaggaatttgaacctattctcaagctcaattcataagcagtttaggatattagcaattagttctgattctgattaacagatgaatatcaacgtggaagaaggaatctagtacatgtcataaggttctaccattggcattatccagattgttacttatattaatgatctggatgaaattaaagaaaaaaatgatttctaaaaattttcagcttgtggagactgtgatgatggcctgtagtacttggatcagttgaagaagatggaaattgtagtggtaaatatgactctgtacttgggtttcaaaaatatagccacacttgtacatgtagaagcaggcttctaaccaatacttttatttttggttgggggagacggataaacaccaggatgttagctatgttaatagaagcccaatataagtaaggataatagtgatagtctagataatcatatatcaatataatcatgtatcaataagagcatgtatagactgctgttttgtgttctagtcaccccacattaataggataaagtggagtttgtcctagaatgagcagctaggatagctcaaaagacttgaactcttataatatgaggaattgataaagaagaatgtttatgagcccgagaaccatctttcattatccagacctcttttttacacaagcaaaagcagactttctgtgcattttgaggaaaagaatcaagactattggcgataactatgagattaattatggggagtcatacttggacgtaatagaagtgatcatttccagcattcagaggtgtacctagatggaatagaatctgccgtagacattgtcatgtcttctctacttctggatacatgggaggattccatttccccatctcactaaaattaggcatggccatgtgtctggttctagccaataaagcacgcatagaagtgaaagtgtcgcttctgattcaaagcatttgattgatactgctttaccctttagcactctctccccttgggttaaaatggacataccagctatgatctctgagtggttacaatggtcagagtgtctcccaatcacccccaatctcaccccttagacccagccacacacctacattggacaggtagtttgaatggaaaataaacctttgctgtttttagccactgaagttcaggggttttattatggcctcctaacctttcctatcctgattgccaccaatcccttcaagatgcaatggttctttgtgaatgagctgcagcaagacaagaattggatgattgacagatttttggttcagcaactcacatacttgcattctttgcattttactttccttgctacactgaattcagactgttgttgggggtataatttagtcaactggaattttcagctggttccaggacctcctgggagatgaatcccagtaaagcgggcagagaattctcttcctaagcacactcttcattaactccactgtgtgcccagcaacatcacacatttatgaatcctttttactttggcaacagctaacaacaactagatagttcacctagcaaagattctattgccacacacattatttatgaaggttgcgaggcccacacaagagctcaggggaaaagtaacttttgaacatgaactttgcagtttgagtttgacatgtttcatatagactggactattgccaagtatctcttcccgtctatgcatgtagatgcattattgctagtaacaaagtttcccaaggatgccctccttccatctgctcactcatgcaactgaacaaagcacattgcataccccaagtacccactacgtgttattgttaaagatgatgagtgctgggaattatctgatatgtttataaagtggttctgtctgggaatgaggtttatgagatggtaggagtcaggaagtgaactgaataacatatgtacctagcctgagaaaaaaattaaaaaatggaattaaaaggtcatccgatggggaaaaaaatggaaagggcaaatttaaaattataattaaaaatacatatgcatgaatatatatgcaaatatatatgtatttttgtctttatataacaattttatataactcacagctaattaattggcatctcatttttgttgttcacaggagaccaaaatcaactgtgttcgtctggctacaaaaggtatgttggcatctgcttgtctgtcttcacctgttcttcagccatttaagtatttctttctagccacacagagaaagattaggcaacagtaactcaaaacaagaaagaattgttattttcaccggagtcatttgcatctagaacatacattctagggtgtatattagtagcacagtgcgtaaaatagagtaaaagtttaaaacatatttactgaatggatggatgggtggatgaatggtgtaaaaggatggactggtactttgatcagtggagtgatggatataaatttactcaaatattcttttgatatatgtttttcttatatttgggtctatgtttatgtgggtattttttaagcatgtctattagacccatctactgagttctgtacttcgttctgttggtacacagctttcaaaaatgaggtgattagtactggggcctttagtaatgagaagacaaacgctgcattattacgtggttggcattttcaacacttatccccaaaactaaggcagcattgttcaggctcatcacttttgttttcctaattataattgaattgcctggctctttcagttggtacatgtttctgtttattactctttttaaaaaacaaaatcaatgaatggtttgctatcgtttaacctattacagggttgaatagttagaaatcagatgtatctttttgttacagagttgatatttttaacagcaaaccctccccatacacacacaacagaactgggcaattctactctgttccctgaatttactggcagcatccatagtttcatagactgcttccaaggagataaaagtggtaaacgtaagtaggcatataaccgtagatttaaagtacagagaaaagcgatgacccaagtatgtatgtgtatgtgtgtaaatatatagacacatgcacaacgacaaaaccacacagaggaacataaacacacacacgggcagagtggggagaaaaagagagaaaaaaatctacagctacttgacgaaatgtgcaccaagacccatcacacatgacttttataactttgaagaaaatcagcccaatatgtaggcacaaaagagaagatgcaggaggaagaagaaaacggaagcactagggctccctgtgataagaagtcaccatgatttcacatgagtcacagagggtgacatgtccctaacttgttccctctcaggaactcaggctcctggatggaaagagataaaatactctctgtgaggcaaggagaattgatggcctgcaaacaaaagtgacacaaatcacagatattggcagacttttccactgaagaaaacagataatgtagaaggaagaacaccatcaattgggtagcactagggctctagacagcaatcgggagagctaggtgtctgcagcctgcttaaataagcagctggagagggaaggaaactcacagagaaagctccttcactatggtatgctctatggctcctcggtggctttcgatttctagaccaggagagatggatgcaatggatttgcactccatggggtaggtgggattctaaggacaccctctgggatgtaagctctattagagggtagctggctgggtcataatttctgaactgagaattggaaacatgagacctgacaagcaataggaacatatggggacagtggaagaatctctaaaactatactctcctgaaaacttcaggactgcagtcctcagagacatagaagcccaccctgctgggcttctctagagttgctttgctgatgtgcaagagaattgcagtgacatttaaagaaccagacagaagagttctctacctctccttagcataagggcttcccctcttgcttgagctttaggttaccatctttccttaagtgaatggagtgtgtatgcaggtaaagtaagcgtgtgtgaaaggataggaatgcatgaatgagtgtgaatgcccagctgtccaagcccaggcaggcttctgagaggtcagggtattgggaaatcagagcatccgcattctggttttccaatttggtgagatccaacacttaaacccaaagaaatgaggctccagtagcacttgggaatggggtagagaactagatagtgcagaatgtcagtcggacacagttcagttatcccctctcaccacatcagataagaaggatgcttggggagcataggacaaagggaagcagacctgtgtttgatgagtgtctacttggtgcctggtactatgcttagagtacctagggttgattaaaggcaaaccctatctattataaatccgtccactgcccgtgaggagtttgtatcaagaacctaaagctgggaatcaatattctgtttatcccatcccttcctgaccacccggatcaaatttcctctaggcagccttcctgaaaacagtattctttttaacacaggaagatactgagaatcccacggactttggaagcatatgaagtcccagagatgggtcaccagtctctcccaaggctcttccctctctctgtcatcacggcagctgcttcatgggtctgatggagggcatccagaccctgaagtccatatgtcagactcaaggccagtactctggtgatgaagcaacttgccgctgtctggtccctgaccctggagagtccagccactgtctatgaccagctacatgaatcccacagaaccagatggttgccagttgtaacagccctaagcactcattcaggatcattctaacttgaccccaagcctagtaccccttacacaagaatattagacacacacctggctccagcatgtgtctccaaccctttcctttgtgtaatgttgctactagtaactctggatctaatttagtaccacccagcttggacggttgcaaagtaatggacctctattagtttcctgtggctgctgtaacaaagtcctacaaattggttggcttaaataacacaaatttattgtctcacagttctggaggtccaaagtctgaaatcaaggtgtctgcagaccttgttccttctgagtgttgtgaggaagaatcttttctacgtgtgtctcttagcttctggtggtttgctggcaaatctttggcatttcttggcttttggaagcgccaccctgatcactgccttaccatcacatgacattctccttgtctgcttgactgtgttcaaaattcccctttttatgaggatactaccacctaatccaataaggatgtttgattagggtagcaaaaagcaagggaatttccttgaatataaaagctaaaagacattttgagcactttgcttgacacactctagacctgggaatcaatctgatcagagccatagagagaaaactgcagccagtgggtaaacaggcattaagtgatggtttggatttaaaactattattcagactctgaaaggaagacaatagaaagccacagagcaaaaaagagcaatttaaaaatcaggttttgttcttatcattaaaataggaaatgttagaaagggcaagtgagcaggggaatcatttagaaccatacctttggaagatgagggatgggctcaacataggtagcaggttgaagatgtcagccacaggtgcttaaggtgatcctttagaaaatggagcatgtggaagcttggggtagggacttagacttcagaggtgctaatgctcaagtagagagaaaatgacccttcccatgagaggtacattatcccatctggtagaagatgccccaggttgcagctgctaaaggaggtacccaggtatctcaattcatgtcctctggctgagacagagcaggccaagggaaaattgtttctgacctagttgttcaattctagaactatattgttcagtccccctttgagaaactgatgcccagttccatccaagttctcttacccactgatgtcctgtctttctaattcttccgtgactcctttcttgtactcatctgttcattttgctacttttccttacccacaggccttgccccaccagtcttgcctgcgtgatctgatcccttcctccctccagcctcctctaagcttctatccttttattctcttattacactctggcacactggtcttctttcagtttttcaggcacatcaaactcctcccaagcttggggccttcgctcatcttgccctctctctgaaatgctttggctactatatatgtctccttaatagataaatatcttaacagagaagtatctttaagatggcctcttaaaccttatgtcctcagaagaccatcctgacctctgttttaatgtatatccctaattttccactctcactaaaccctgtacttttccttcatagcactcatcacaacttgcaaatatatatatatatatatatatatatatatatatatatatatatatatatatatatatatagtctacttacatgtttaatgtctatctccctgctagactctaagtgacgtaagtgcaaagactgtgcttattttgagcactgttttattattcccagatctcagcatatactggtactcaatgaaatgcattggatgaacaaatggatggatggatggatggatggatggatggatggatggatggatggatgagtggatgactaacaggtcattattcttccatggcttcatttttttcaaatgcaagttacatgtcaggattgttctcttaaatggtaggagtaaaagtgacagaggtaaagtgtccactatgggatctgcagtccccactaacaagaaggccagccagcctctgtttctgttcctgctgtgatagagatctctctacccaccatggacttgcttcacactttggacacttccgtttgagagggcttctacattatgagtccaaactggctccctattatttttctgcccatcagtccttgaagtcaaatagattctgtctaccatttctcctttcagaaaatgaaatttgcttcctctgacctgctcctccagccttggttagggtcaggaaggtgcatgcttgcttctttccattgggtggaaccactctggctgccagcaggcagcagcactcccatcttgtctccagcgccagccgtcaagggaacacagctggctctgcagactcccgctgggtgcgcccgagtggcagttagaaaaatcagctttgatttgatttgcaaactgagccgagtcattgagacaaaataaacccagaaacccataaagccatttgcagagttgctttgcagaagacagccacagttttaatctagtaaacactctctaacgatcccattaaaacaacccccttggagtgggtgctgaaagctgaactccagaataatgaagcataggatgaggggccagtgtcaccagtagttttgttctgcttggtggcagcgatggactaacgccattgttccaatagtgacagcaagaggtttgggcgctggcttttgtaaatatgccttcttttcataagagctaagcctgagataaagcatttcatctggcattttcctctccttttcccataatggattctcactcctgcagggaccagcagggacactaaatagccatttttcagtgagatgctctcatttaacagatgctaagactggggcccagaggaggagtgatgtgtccatgccttgtttatccacagaatcacagccacaggtggtgtgataatcctctgctatcaataggcaatgcctactcccattgatacaagcctatgtggaagattctgttttatataggaagcttccttgagaggttgcatggaataattggaaattagaaacacctggattcaaatcctgtcccccaaaatttagctgttagaccttggacaagtcagttaaaatctacgaatctgtcccttcactttgaagcctgagatcggtagccctttctaccaagtattcaagaacattatatatatatatatatatatatatatatatatatatatatatatatatatatatatatatatttccttctttctctcttcctttctgagtctttaatgtgggacttggagacccagacctactaagcacagatcctctctctcagttctctaaggaaaaagccacagcccagactctagtcactgcttgtacagttctacaaatcagccgtttgtcaaatggatacaggttagatccaaagtgaagaaacccagaggggacaggagtgatgttggcctcacttttcagtacttgaccttcccattgataggttgttgtctctagatgagatcctgcagagcaatagtattcttttatggacatgtataggattgtggtcatcccttttctagccttgactatgacactgtcctttcttcatcaccagaccagcaatttcaggagggacccaggagcatagcatgtccaaatctagctagagcaaccagggtaggggccataatggggaatcacttgtgagaggaaagactctagtgagatagtctattggaaagctcttgattgttgttcagtctttataaatcttgtcaaacttttggaggtgaaagctcagactgtgtggctggagggtttgggcaggacaatgctattcttccttagctgagtcccatgagatacattttccaggactgggatcctcagagttacatgagtgtaacaaattctccttgacttgtggccccctttgctctcactgactgtcttctaggtcctaaaatgtcaatggaaaaatacagattttcctaaaggttttgcaagaagttggaggaagagaactatatcataagtacacataagatagcctaaatatgacctttaaatatcccaactctttctttaatatttttcttgctacaacagctggcacatctctctagcctctctagttgtgctcaaacttcccccgccacacacaccccttccataccccacttccataccccactcaggaagacaaaagctggtttgatagagttcagaaaaacaagtgaggattaactcttgccattcaagcatgtaccttgggagttccaatccatctttctcaactagaaataagaattatctactcaagatctgagagacacctgagtcgacttgatcgcaagtctgttattgcaaagcagttgcatcttctaaaggaaaaggggggccttttaaaattgggagtccgggaaggaacacatttggggtaggctagagacaagggttataaataaagagaataaagctctattggatattttaaaccccattgatgggatctcaatgtgatgtttgaggagggattaaaagggatttgcaaaaattaaccacctattgtgtgccagtcacagggctttgtgtgctgacacaaggtttcagtgtgatgacagaagtaaagcctgacacttagcacacactaaataaatagtggtcatcgttattacttaatgatgggccaaatgggctcaaggggttaaataaggagctcaagtttcctcagaattggaaatcagatctgattccattgtgttaatactatagacagatgagattcattgaccactgacaggatgctctgtctcctacctatttgttaacctcttcccatgcctcttttctagtaataattgataatagaatatttagcatgtgatggtctttggcctgtctccaggagtattcaagctaagtcctggagcagaaggtgaggtggctcaagaaatcctcaactttcttcacttccacaacatattgaagctaataaaccaaaaaattagttagtcttcagggttgtctgctccagggccatctgtagcccagcagcatctctctgcactcaacactgattgctttagaagggacaagagtcagaagggaagtctgagacattcagcattctgagctccttctttgcaggctaacacacacacacacacacacacacacacacacacacacacacacacacacacactgtacagggcctggaaacagtaaagagagaagggtaatgaatcctcaaaacgtgatgtggtcaggggaccaggtgatgcaggagaaagcaagagacctctacctcagcaactggattagttaggctaggctaggctttgctaacataacaagctaatacccaactcccagtagcttaataccacaaaggcatatttgttgctgtgccatctagaatatatgtggtctcagagaacccctgagcaggggaagagaaagcatggaagtggcaacttggatcttaaatatgtcactcggaaatgactcatgccacttccacttacatggccttgatgagagctagtcacatgacaacagcccaactgcaagttgactggaactctttcctatgcccaaggatagatggaacagacactggtaaacatgagacatctctagaaccatatatgtaaacaggacctttttctgtttctgcctccttttgtgttttgctgagatccatgatccatcccactatattctgcccaccaactagaaaaatctctccccattcctgcatttatccagctgtccctctgttcctaccccagatagctgagcattactgctaagcacagcatgggttgcagacctagaggatggagtggggaggtacctcctctaggcccaccaacccaactaaggctttaactcttttccatttgatcctcaagatgacttcatgagataattattacctccactttataagtggagaaattaaaatttagaaatgtatgtaattttccaaatgacacagctagtgagtgaaaaatactgaatcagactttcatgtattcatttacttttcagtaagcatttattgagtacaacttagtattgatatgtaatcccacattccctagtggttaaaaacatcatctttagatttggatggtctttgattctaggtaggaaaaggtactaaactattctgtgtctctgtttccccatctataaaccaatgacaataacaccacttatggctgggtgcggtggctcacgcctataattccagcactttgggaggctgaggcgggtggatcacctgaggacaggagttcgagaatagcctggccaacaagaagaaaccccatctccactaaaaatacaaaattagcttggcatggtggtgcatgcctgtaatcccagttactcaggaggttgaggcaggagaatcgcttgaacccaggaggtggaggttgcagtgagccgagatcatgccattgcactccagcctgggcaacaagagtgaaactccatctcaaaaataaataaataagtactaccacttactgcacagggctaatgtaagaatttcatgagaaaatgtatcgaaagtacttaatataatacctggcttgtaagaaacactcagcaaatagtagttcatgggagaggcaatgaataaatataagtccaataagggctgtcgtcaaggcaaaatcaggatgtcactggtgggcaagaagggagacataaatcaacttagggtatgctatttcagaatgtgtgatcactgagataaggtttgaaagaagagtaacaattatcatgtcgaacaaggttgcaaagtaagtcaagaaagccttcaagccaagggagtaggtatgcaaatcactgaaggcaagagagcatgccactgaatttaaatgggacaaggcaaaggaatgatggctagtaggccagtgtgaccagatgaggttaggagtgatcaggggccacccaggactctgtgtagccccactgtatgtgtgtgtgtgtgtgtgtgtgtgtgcgcgcacgtgtgtgtgcacgcatgcgcgcacatataaaagcattgtccttagatagtggagcccctggaggtacttaagcagactgcctttttggggaaggacaccctagttatagtttagaaaatgaatcagagaaggaagactaaggcagggagaaggctacagaatgggagagcagttaagaggctgctgaagggggccaagtgggaacatgtaagtcatctcttctctgaagctttgcatttcttttactgacatgtgagggcgacagtctttgtcttgcctatctgagagcattggggttaaaaaaaaaaccctaaaaaatagccacttagaacaggagttagcaaactcctctgtaaaaggacagatagtaaatattttcagctttgcaggccttatggtctctgtcacaaatactaaagtttgtcattgtagctccaaagcaaccatacatataagaatatgtataagaatgagtgcagctgtgttccaataaaactttgtttatggacactgaaatttgcattttatataatttccatgtgtcacaaaatattactcctctttcatttttttccccaccattagaaaaatgtaaaaagcatttatagctcatggctgcacagaaaacagggagtggggggccagatttggcctacaagtcatagtttgctgacccctgacttagattgtgcttttaaaacagcaaaacttttcatatttttaagggagaagtattatgattactatttactggtggttaaattttatagtatttcatggctgttgatcaagtttgccatctgtattatttttgaaattatgtattttttgtttatcagttggtctggaatactctatcttctcaattttgcataagaacttcctgcagttttgttgatggatcactggagaaagctgcagtccctggacaagcctaaaacacctttcaaccttttgtatgtttttctttagagaggtgaggggtggatttgaaaggacaggaacattaaagccagacaaaccagggtttgaatacaacctttaccagtttgtgaccttgaacaagttttacaaattctatgattcaacatttcttcattcattcttcatttattcaacaaatattcactgagtacctactatgtgtcaggcacaatgcaaggccacatgagtacactagtaaatgggacaccgtgtctgctttcaaggagactacagatttaagagaaggcatccatttctaatacagtgatatattgcaataagaagggaagatgagggtgttatgggaagacaagaaggggcatctgtcccagattcactgacgtactaaagactccctagaggtaacaggttataaactgacacctgacggatgaacagttatcagccaggtgaaggagcaggagggagtatatcccatgcaaagtgactcacctaaggaaggcttacatacaagaaggtggggggctgttgataatggaaagctgttgtcatgcttgggacagggtgggcagtggtagtgaagagagacaagaccagaggggtgggcaggagattcatcatggagggcctgtgagctgagtgaggtggtttgaagtttaccttggggacaacgaggcagcactgttgtatttcaactgaaggatggagagtaagactgaaggggaacaagactggaggcagagagaccagacgacaggctgcttaaataatccatgtgaaacacaaggttggcttgaacaaagtgagaatgaaattaaagagaaggaagcagcttcaagagcttttctggggtagaattaataaagcatggtgattgattataagagggacatcagaaaaaaggagggctcccatgtgtctagactgagaagctacatggatggtggcaccatttatgcagaaagggaagtctaacagagaagtagtttcggtggaaaaatgacagatttatttatagtcatactgacctttctgggttattctaaatcttagaaacattatatgtgaggcacccagaaaagtacctggcatgtcgtgggtgcttgataagtggtgcctcttactcttgtttcattttttttaaatctatttcaggccctgttttgttaaatcatgatgttcttttgctatttagtgtgagctcttcagagccacaagaattgcagttttgttcaccgtgctgcacgttttcatgtgtgtttctttctctccttctcttctgcatgctgcctggggactggcttccttgtggtcagcaccaatgggcagcgcccaggtgaccccggggactccactctgcctcctcaccacaggtgatcaccagagccctgggcgggtgggaggggagagttgcccacactcagtgggtcctccaggccaggtgcaccagagaggaatcagcagtctttccaccccacccacccacccacccccccacccattcacccatcaacccacacattcattcatccacccatccctccatccctctatgcatacactcatctatccactcacctattcattccttctactaatgcttactaagtacctactgggtgccaggcactgttctaggcatggagatgtacaatgatgagcaaaagaagatatgttccagtgcctttccaggagaagaaacagccactggtccaaaaactacacaaataaatttgccacttcaagtggtgttacaaaggaaaggtacatggtattcaaaataaacaaacccatgtgcagccaaaggagtgcttcacaggggaagcgacagctgagctgtgatctaagtttgggaaaaaagttgacataacaattctgtgcttaggaaatgagaagctctcactatgatcaggtctaccatttgtcctgacaatttacccataccatgatcagcctgacttttcctacctgttaaataggaataatcccacctaccccttatggggcaccatttacgttgtagaccgtacacatgcagaggcctctgagactaaacaagataatagacatcgaaggagctgccatgggtacgcccagtccagagtctgtatttgtttgaagtgaataccagcccctttcctcaagtgtaccataggtggagttcatttcacataaatgtatgccattcttcaaaggacacagagcccactcatgtcagaggttgatgtccatcgtggggctcaaaagataatctgctgacctagagacctctttattacagggtccctttttagtcaatgggaagtttcttggagatttcaaacctttaactgtcacctctctcaaagtccttgcccagacaatggcctccggtctactaatccctgaacggtcagtttatcatggtggagaaggaggtgcagcaggctgtgatgacatgagtctgggcatccagtaccttcacagttcactcctgccaccctgtttcccaaactcagagacatcactgctggtgaatgtcttaggttgagttccctggacactgagactgagatggagattcttgtgcaaattattcattgcagagtgttctcagaagaaagggaggaagatgagatatggcagagaacaaagctaaggggggatgtggagatctgcatctacctgagccctgggtaaaggggaggtctggagtaggaaatgtactaaagagttgggcccaccttgaggcaagggggccaatatttgtaccatggtgttggtcagccactggctgtgggctgccatgggaatgcatgacctcctggggaagtggttcccttatgcctgatggtacttctctaggaagggaggtatttgtgagccatttgcgccagcacccacagcagctggagagtagtcacacccgcccagtaaaggagattggggctgagcctaaacagcatccactatgggcaagttttatctctgcctttgtactgccatggacacctgtactccagtgtgtcactgccaacaccacaggaatttcatctcagccactccctgttagattaccttaagcaagttgcatagccttatttcacgtgcaaaactaattatcatatgtgcttcatgcagtcatattaaaaattccattagaaaatgctaggaatgttgtgtgcagttgcagcacatagtaggtctttactgaaatcagtccccagccctaccttatcagaggcccttcccaaagggaggtgggagttgcagatggacagtgggagaaaagtgactctcgtcactgtgcacaccaccaatttacagagaaacaatacttctccagagtgtgtgcgagctgttccgtttctgctgggccattgttctctaggctctattccagtcgagcagtcagataatattttctttaaacagagccagtcccatatcaggtgcttttgttcttacctcttgtcttctaaggcgtctgaatgttcctcctctgacaggtttatttcattgtgatccatttatttccacacgtttctcaacctcatttgatgggtgaggtgcctgtgagtgccatccctttcaaagggtgtttttgttaatgttcgtcccctggtagcaataatggctgatgtaaataataactgcctgggtctgagtgatggggatattagactttaagcacaggagcctcttttcatatcagcaccaactcagagagctgcaggaccacattatgtagcagggacaggctggcattcggagtgagtggaggctgagttcagctctcagcaatgccaccttctgggctggtgatcctggataatttatttttcttttccagacttcattatttttatttggagaaattgaaatatgaatagccacagtcataggtaatcatgagaactaagtgcaataaaagctttaacttctttgcccatctaggtccaattagttcttcaggtcttcctaatttattggctaatccttcaaggaattcattctctatggcaagattgctcaaccccagcaccatggatgtctggggccagatagttctttgttgggggccggtggcagggggctgtcctgtgcactgtaggatgcttagcaacatccctgcctctccccactggatgccagcagcacgtcaaccccaattgtaacaaccaagtacatctccagacattcccaaatgtgccatggagacaaaaatcatcctctgttataaacctccagagccatactgtttaatagaaatagaatttgaatattgtatgtaattttaaatttcttagagtcacgtgagaaaagtaaaaagaaacaggtgaagctaattttaataatataatgtatctaactcaatacggatccttctcaacttatgatggggttatgtcccaataaatgtaccataagttgaaaatgttgtaagttgaaaatgcacttaatacaattaacctacggaacatcatagcttaacctagcctactttaaatgtgccatgctcaaaacacttacattagcctgaagttgggcaaaatcatttaacacaaagcctattttatattaaagtgttgagtatctcatgtaatttatggaatactgtactgaaagtgaaaagcagaatgtttgcactggtacttaaagtgtagtctctgctgaacaggtattactttctcagcagcattgtaaagtcaaagaatcttaagcccacctatcttaggttcacaatcatctggtatatccaaaatattattattattatatgcagcaaaattaaagaaaacaacagatgaaagatattttacattctttttttgtactaagtctttggtgtgtattttacacatagaacacttcaataaaataaatttttaaattcagttcctcagttacaccagccacctttcaagtgctctaagtacgtgacttggtgactaccattgtgggcagtgcagatcaagaggtaacacatctagggtcatctttgtccctagttggtgaatagaaatgtatgtgtagagaagaggctcagtaaatattcagttccttttattccttgttgctctctaggactaggggacgtttggcaaaatctggagatgtatttggttgtcacagctgggtgcgaggggctatagtcacctagtgggtagaggtcaggaatgtttatattgagaaaaataaggtaaaatcctcttctggccaggattgggcacttttctgcagtgagctgactggaggctgcagtagagaagtgaccagttaattaacattaagagaactcagtcttccccaggcccaccagtgcagaaagaaggcctcttttcacatccctcctgcagttcagccaggcctcaagggggtggcctggacttctgagcccaagaggagactgacagtgtccagtctggaggccagagtagctgtgctaaaggtcatccccagtggcagatctgacttcattgtcttggccatgccccatgcccattgtcaattttctacagaaaaaagagctgtgggacaagccctcatctggagcccaaactccattccttaaaactggggaccttgagccaattactcagcctttcgcctttctgagcctcaccttcttcatttgtgaaatagtacagttgagtccctgtacagccaggcctaatcatggtgagggtcaacagaagaaatggatgcactctcaacccagctccaggtttgagaagatattggatacagcttcccttattattcctttatttcctgtgtacctcatgttaaaactctctcttattatttcgctggaaattctttaaatcacggccttggcacagtgacaggattcaggtcatcatacactctctgggagttcttagcaactgtccttaaagcaactttcccaggggcagctttactcagacccaggcagaaggagtttgagcctttgggagaaagctatgtgggccaagagaagatgatgaagcaaggcagcagtctccctagggtcatgccctgggccctgtgagcttggacaccctgaggcttcagtgaccctccaagggagcatgtgcccagtggaaggggttgacagatggtgtgagaacaggaaccagaggcaggagaaccgggtgaagctccaacctgaacagccaccatgaggggaaaatgcttcatggagagaggcgaagacaggcagcagaggcaggggcacagcctgtcaggagagagggggcagctctgggggacaaagcattgggaatgtccaataagacgatgaaaagaaaaatataacagcaagtatgttacatacttcctacatgctatggaatgtgctgagtttcacatcattaactcatttaaacttcccagcaactctgccaaatagagtactgttagtagtcacagtttacagatgaggaaactgagggtcagatgattaaaaatcactcaactctgaaatgatgaaactagaattcaaacccaggtctctcaagacagtctgtaatcatactctccatgctctgtgcccatagacattagagaacacccattctgagccagcattgggaaataccatggcaggatggttcaggacagtctcagaagccacataatttactatctgagaggctttgagccccaaagtttccccattttcttatctgcaaaatggaaatactaaaaatgaccagttattgagaagaatcatgagataaaaaacttcattatcttagacttgtgccatcattataatgatcttaacccatcttacagatgaggaaattgaggtccagagagtgagcagcaggcaagctgaccattggtaagattcaggcagactgaatctgggccagactgtgactggtgactgggccagaactgtggtttctgagaaacgtgagtggtggaggaaataggtaagagcccatcagggcctcaggcctggggcacctaaagtgccaaatagaagtcatgaatcagggctcatcaaagctttaggatataaggtggatggctgggcacagcagcacagcaaccccagctcctgcagtgacccaaggcaagagcaagactgagagctgagataggtgaaaggatgtggacatccctgagcctttgacctgggcatcctctagttccccttgaccagtgctttggttggttctggagtgcacaaaggtcatggctgtgccagaagactaggggaagagctacagctggaggccacgagggcaggtgacatccaggagccaggctgatcattgcagaggaccctcctcagctgttctgggcaactactcatatggctgtaaggctgacactacagaatgggggaggagacgagccttggatcaagtgcattaggatactgtccttaacaacagtcttagaacagatgctcaaagcttgacagacacaaggctattggtacatcatttgagctgccattttctgttgcccgtctccccactgaatcaaaagacttaatgcagaagagggttgtcacatccctgtagggtgttctgtgggagatgattgttaatgtttgtgcttcttcaaaacaaatgtctaatcagggagcatatatgactgaggctctcactgcacctttttctctcctgggatattctccttaaagcaaggagaaatcagtctccagtcttccattcaaactgccattaaactcagattcagaagccaagcatcatccttgccttctctttttcctcatcttcagtatccaatttatcactaaatctgatagatacggcctctgaaatctctcctgaatctctgtctccttcttgctcactgctacaactcatgtctgggactcataaggttagtgtcacagattccaaattggggtccccatgtctttacatcaatccccttccaatatttattccccactgaagccagagtgatcatctaaaaataagagtatgattcaggccaggtatggtggctccacacccataatcccagcactttgggaggctgagtcagtgaattgtttgagcccaggagttcgagatcagcctaggcaatatagtgagaccatgtctctacgaaagtaaagttaaaaaaaaaaaaaaaggcccggcgcagtggctcatgtctataatcccagccctttgggaggccaaggtgggcggatcatgaggtcaggagttctagaccagcctgaccaacatggtgaaaccccgtctctactaaaaatacaaaaattagccaggtgtggtggcacgcacctgtaattccatgtactcaggaggctgaggcaggagaatcacttgaagccgggaggtggaggttgcagcgagccgagatcatgccactgcactgcaccctgggtgacagagcaagactccgtctcaaaaaaaaaaaaaaaaaaaaaaaaaagccaggcatggcagcgcatgcctgtggccctaactgaggtgggaagatcgcttgagcccaggaggttgaggctaaagtgagccatgttcatgccactgcactccagtctgggtgacaaagcaagacccagtctcaaaaaaaagaaaagaaaagaaaaaagagagagagtctaatcctgattaaaatgctcccagggctccccttgtgctttgggataactagcctgaatcaaaggccatttaccacctagtgcctatcccttttttatctctccaattttatttcctcctcagcatcctgtaacccgttcaaactgatcatgtgagtggtacttgccttctcacactctcctctctctgctgagatgttctccctctatggtttgccttactcatcctctaggatcaagttcagacagtttgatctctgcaaaacctttactggcccccattatctccagattgcatgcagagatagtcaactgggtgggccacttggcacaaagaactgcaaccccctcccccgccctaagcaaagttttctattgaacatggcatatgtacaaggtataagcatgttttgttggagctgtttggtttctatcaactctttccctgtgcctagcacacattgtagtgctcattcatttgaccccatgcatgaatgatttaataaataagcagatgactgacattgatggagcatgtgccaggcatggtatactcacccccatccccacttctgcctccagcctgtgatggttcaagcacctcactctactcaccatctaccattttgttgggctaattgtgagtcactagttttcaatccagtatttgaactccatgcagactcacctgccaagcttcctagagactgagtcttcagagcccttgtttggagctcccccaaatctgctggagctggtcttgctgagcccagtgtctcgcctgggatctcatggtgttggcccaaaagaggttgggctgggggcaggaatcgtgggcagtcatagggaagaccctgtcttaggactctgtgccagtgtggcaagtggcatctgctacaaccacactggccacttcttctaccctcctcacctcccactaagagcagagctgcttttccatccatcctttggggaggggaacagatcagcttttaatacagaacacagtgattcagtgtttctgctttcaaaagcaaaggggcaaaggctagaagaaagaaaacatgttcatggtggatttggctggaatctcaacaatcaattccgtgcttgctgctgctcattttattaccgttgcacgggttagttgcactaatctgaaattctgtgctgcgtgtttactggctcctctgtctgatcctgcttatgcttccactaatccttcctatagattgcctgcttcctcccgtgccccttctctcctttccaggcactctgatgctagctgcaagcggcatgttgcagatgcgtaatctggacaaagctgccccagatgggcagatctttgcttctcctcccctttcttgcccctctaagtcaggtaatacagtcaccccttaggggatcaatttggccagagttggttggaaagaattgaattatgtttctgagtatgagcctaggggagcctcggcctctggtgcaccctgctatgcagttcagacaaaggaagctgagacatattatccttccagaagccttgtgttctgctcagtccacaaccaagcaggagcccccattcctcttcccacatgctgcctgtccatttggctgtgaacccttttagagtttgcatttcatttagtgaaatgctgagctcccgctcctgcttgtagcccatccccaggctgtgtgggtcatgactcagcttcacctggtcttagaagttgaattgtgttccccaaaaggatatgttgaagtaataaccccagtacctgtgagtggaaccttatttaaaaacagtatctttgcaaatgtaattagtttagataaagtcagaagggtggacactaatccaatatgcccggtgtccttacaagaagagaaaaacatcatgtaaagacagactcatagggagaaagtcattgacaacaggggcagtgattggagtgatgcatctataagccaaggaatgccaagcattgccaaccactagcagaagctaggaagaagcaaagaagagttctgccacagtctcagaaggaccatggccatgctgtcaccttgatttgggactgctggattccagaattgtgagggaataaatttctgtccttaaacctcttgggttgtggttatttgtaataacagccctggaaaatgaatgtacttagaaatgcagtgatcctgagcactggccagtgggcagtggttgagctttaagggctgtgcctttaaagtgggcagacctcaagaaaaccttggccaagagctgccatccagagaatccctttggctcaccccatctccccagtgaggtccccttgttgactgtattctacatttggcccagacaggtctccactctgtggctctaaaccttcctttcttggtttggtttctgcttctccctttgaatagtctcagcatctgcttgctggtcatgccctggcctgggctttgcttcacaagccaggctgtggtaacctgttctcagtgtcccggaattacatgacctgcagactgtccctgattggcttttgtacttggctctatactggctgctcctgagaagcctctccttggcccattgctgccctgggactgctctgagcttcacaggaagaattacagtcagttcagtgtgaccacagctctctcatactggctgcctgaagaactctaaagggactatcactttgctgcagggcatcctaaagagtttatgttcttcttcttacatctgttcttcagactaaacccttaatccccagtgcaggccgtgggtgctcctgcctgcagcagctaagcggctttgagcctcctgagctccaggctcaaagcacagattctataagcaaggagccagtactgtcagcactgagatgactcagcctcttcatccgcatcagcaggacagtctggaccacagggagtcaaggtggggagggaaaagagaaggccactgagtggtcacaggaatgccctgatgtgtcccacaccatggatgacgtggaaatcaagtttgtagtctagttttgtttaagcagagctgggcatgccctttcctgtgcacacttctgtgttggtgcccatcactcaactctgatttttagtttgcactttcctctccccctaagtagtgagttccaagacagtagtgttgtctaattaccttccatgctcagcaccttgctatagccactgtcatcattataatcctagcaccactcaggttaggcaatgtccaggactattcctatgaagccaagggttgaactgatgctaatgagaccaaggtaatggatatagtccatgtggaggtcactgggctttgtccagttattttcatggccatgggctacattttatttctgaataaagtctaagccacacttgtgggcaagtttgaccccaccatggatgcagactgactgccataacacttctaaacccgagccgtaagttgactcctgatctctgctttagctttgacccctacctcagccacatcctggtcattaaccttgactgcggtctgaaacctaacccagtctacaaagtatgccctatacttggtttcttagacaaccttatacctgactctagtcatagcttaaggtcttagtcttaccacagactgaatcctctctctaccccagctgggtcttggcagccctcataggttaggcctccttggcacaacagaaagtagttgaggtcattgggaggtataaatggatttccagctcaccaacggtgaaacctttaaaaggatatgccatagaaggggtgtgtcaataatgactgtgtctggcatcagttgggcatgactgctcataaataagtctgttttcctctatttccatggataaaaaaaagacactttcttaatagaataaaggagttttcttacatccagaagacgttctctatcagagtctcatttagccgtctttcctggtgtgtgtaacatgactgaactagaatttgacctacacagagcatttacagtgtaaaacaaggtctatctggaagcatagattcaggagaccaagcaaaatcagcacttgaggaacaatttatttgagtggcctgagtgctttcaaacaatcaattaaagctattcctgtctcacagggtgctaacctccattcgaggccgaaaacgagggcaacttctgtcagcaatatttagcagttttagttgtataggctgtgatgaagtcaattctaacttcttaggactgactgggtagtattgaggagtctggggtattagaaatgtgtatcttctttgcatttaacagtacttattaagtggttttccacagcaagggtagagctatctttgaaaaccctgcatctctgtggtattttccagctacttaacattgactctgagttaaatcgtgactaaaagcaattactgtcatatgatgaattgaggcaatttatttattacttgagaaacatcctaggtgatgtcacttagaagaatgatgaaataatccttctcaagtgctctattatcaaccagatctggtgaaggaggcattgctttgaggcatggggaggtagtcagcaatttaaaaaaattagtcacagcaagatcaaagaaagaatattggagacaaagcagaaaaaaatcacctaaatttgaacaagacttgtctccctatggaattatatgggatggtttgtttgctaaatatcaataaaggtattatatagaaagcccagcgattataataaaactaactgcaacatatgaaaggcttggaggtggtggttgatatacaagaaaagtgaaaaggatgagggaacttaagttaaaaaggtcaagtttaaatatcatttgagcaaagtctgtataatttggctcatgtaacaaggttcacatgacatgttcatcaatcccttagatattagaataggatacgtgggtgcgagggcatgagaggagataatcttcaagaaagatgcatgaaatagaactgcatgatagagtgggtggcaaacccggcagagacaggcatcaatacaaagatattttaatctggctggtcaatggaagattctagatctaaatacgtgtctgcttctttcttccagatatttgagaaaagacaaacacatttctctgctgaacggtctctccccctatttattagagaggtgacagagtagtacgataggttaaagagaataatctctgtgctagactgccagggcctatgtcccagctctcctgcttgctaccattacttagtctctcagaggctgttcccacatctcagaaataggtataatgatggaacctgcttcataggtgtattagttcattcccacattgctataaatacccaggactgggtaatttataaagaaaagaggcttcattggctcatggttctgtaggctgtagaggacgcatagcagcttctgcttctggggaggcctcaggaagcttccaatcatgacagaaggcaaaggggcagcaggcatcttacatggcaggatcaggatcaagagagagtagtgggcgggggggggggtggggggaggtgctacacacttttaaatgaccagatctcacgagaactcactcactgtcatgaggacagtaccaaaggggatggtgctaaaccgttcatgagggatccaaccacctcctaccaggccccacctccaacactggaggttacattttgacatgaggtttgggtgcagacacagatccaaaccatagtgatagggcagtgaagattaaaagagagaatatatgtgaagggtttaaaacggcagcctggattgtagtaaaagccctagatgtgttacctctttattgttcattgttagcactttgcatgtggtcagatatcttgacccttctgtttccatcttctggaagaactcagtttcacacccggctgtcctgaaagtcagccacagtttctccatgttggccttgacttggctaaaatcaagctgcagttctggacattctccctgacttacaagcccacacacccctcgaaagtggcaaagagaggtgaggctagcatcacttgtttataagaagcccatgcttgtccttggcccatttggtgtcacaaccatcctttactgttgccctatgctcctgggcatgtaggtgacccctgcatgggacccgcatgcctactggcttctggatttggctaatgggagactttaataagagatggtaaagctggaggaagggaggagccttctttctcttgggctcaggccccttctttggcggtgactccatggcttcaggtctccagatgggtctaccagagttccacttctgttgggtgatccttacttctgggctttgagaactccaccatctctttttgtttctccagtctgggctgggtagtggcttcctgatactaccaccctctgagtttccccagcattgtctcctaatccctgtgtactaattttctagtaaatttgctctgttttaaaagttaggagtggtttccttttccctggttgaatgctgtctgatgtgaggctgtgctggtttctggtgattatttcttccttttttaagtggtaagggtgggggtggggggaacctgatttaatcatctagtctatttttttttcctgtatcaacatcacactagcgtaaagtatctgaaatacattttttttttcatttttaaaaaaagtcagcaacagcatttgtttctccccaggcttctcgcacccctcctgtttgctacaatttcagtcctcaaagactgccaaagtagttcatgatcacaattacaaatattctcaatgccttgggatgcaatttgtaaagtctagaggcttgaatctaatgaagtatccagatgctctcctgccaacttcttttctgtcttggactttaattccatcttaaaaataatctgctattctgagaatttgtttccagcaaaatcaagaaggtttatggtgcttacctgacttgagaagagccagaaagttgcccagcatcttcatcttttccctattatctcctcttggcaaaacccccataatcagagatgcctgtaatgcttaaaaccttccctgacgtagaagtaccagcttagagtcagggtttcaaaggttttccctactgggtgccagatacgtacaaagccagagaaactcttcaacaaaagaagccattcagtagacaggggtaaactgccagcaaagtaagatttgcctctgataagccacactggggataatatgcccttggatagctgagaaacaactgtatgttttaaagagtgcagtttttaggaatagtgtccctgagagccgggttgctttctttatcgtcagcaatgatcaccagcatgggttatgcatccattgggatttacttggttttatcaattgcaattaaatgttctttatctgtgactcctatttttgctccatatctttacaaggaaaattctctgaagtaaagctctagaattgggcctgtcaccagtgagagcacttcagaatgaatcattaatcattaattgccagtcccttgttgccaaattatgttattgctgccattaagtcatccagatgcaagcctgatatgggccttgcctatatgaggaaagttaagtgaatcactctaggggctctgcctttatcctgaggatcggatgaacttaggtagcaggttacaaggaggcattgcctcagcctctatgacctacagttcatagacacaaaaaaccctagtgctaccctggatccagtgctaaggtcacatcatcactgtgccccatatgtgaacagttcctcaagagtttatcaagcatttttccctccattattacatttgattcttagaaaatcccagtgtgaacttggcattttctaattatttcataaatgagaatatcaaatcacattgcggttaacaggtttgatcaaggtcacacaacccattagtgatggcatctagacgcaagcttgcatatttccaatgtgaaacccaatgcttttgactagactcataaaaccatagcatctcgacatcaaaaggggcataagaagtcttgtcgtcccttctgctttgtggggagcacaggatgttccagccagctcttgtccttgttgatgacacattcccctgcctttgtgggtaacatggggagggtcagggtgagggggtgggaatggactgcatgggagtctcatggctctaaagataatagggataatttctctcaccaagagtatgagtattactggaattaaggggaaccaagttgaggtaaaagatgacgtcagagaaaaaggtcagcatcctgtagacatgaggtcctcagggcttagttgtgcatccaggaagccaaggagatgagaacagagacagagtaagcaggtaaaatgaagggctgactctgatgcaggactttggaaccataatgacctcatcctctctctaacatgatgccgcattgaaagggtctgggctttagccttagctgattagctcttccacattcaaacgtttcctgtgttgattcctaatctaccccctgtcacttctacccagtgatacagctctgagctttgaaattaaagggaccaaatctactccaccttccacaatggccctttatctatctaaaggcaaaaaataggtctcatctgaatcttcccttccctaagatgaaaaatcctgattcagagtgatgtaccttcaaagtcaataatctctggaacattgtgcatctcaatcaatgtgtacctcaatcatgtagagaccttgttacaatgcagctgctgagttagtaggtctggggtagggctcaagatactgcattttttatagactcccaagtttcgccaatattctggtcgatggaccactttttgagtagcaaggctcatggcctgtcttcactctggaggtccctgttgagaggttgggttcacagctggacaggactcaccagagcattctgaccagtgcagagtagagcagggcagcactgcccttgttaggtctcagtaatccttggggaaaatcagctgggagggttgctgggtagcatgggaggaggcagcagagagagaaaacatggcaactagaccctatgtatggagctaatattgagggagggaagtagagcttaataaaccaagggccatgccttgtgcaccaggtttccatatgtaagagtagacaggtagcacatataaaagccagattaagactctgggctggagctaggaggagactggatccttagccatcatggcatttggggaaagaatagacagcaggatgcagcagcagctgctttgagaactggttcagcctttgggagtgctcagagctcagaggacacagttggctgtgccgtcaggtcaggcttgtgaggcttgcagcatgatgttggagagggagtctcctgtcagtacaagctgagttcacaagattatttttggttatcacatcacacaggagactcaagtagagcctcaaagcttccccaattggagaaatttatcatctggtgcctgcctagatgccaattctgatttgcttggcctattctcagattgggtcctctggagggtaaagatgaggaagatgcacccaaatccctcctccttctcccagttcccaaatccccaggccctgcttaataaaacaaagtcacccagagtcggagacagccttttagggactaaggctgatactaagcctgactctcatggaaaggatatgcttggggtaaaagtaacgcaggtgttatcccactgaagggcttccagtgggatagccctctgaaaagtccctttcgattttggggccactgagtcagacagatagccttctatatggacctactgctggcatctgtggaaagcgcaccacattgccaatggccccatcagtagccaaccctgatgtgcttttttatgactcccatcacaggtcacattctgctccactgagcatttaagatgtaatccctgtggccacacctgactctgccacaaaagcgggaccctcccatcctctgtccatccctcagatatgggagtcacacgtggatgctgtcttgcctttagtccatttcctctatccctgtatcacctttgaaccctgtcaacacacttccactatgaacagaggcacaaatatccagagtctagggcaagttcccctaaagagtgccaaaggcaaagctggattttccctgtcccagggaatgttcacgttcctgtatctgatgtctagttagaccaaccaagcatggatttttctaaaaacctcctgtgtaaagtctgtgatttcagctctgctgcctgttggctgaactcattgaattcgtctaaacctctaggctctggactttcagacagcctctccgaatcccctgaatgttcttctgtggccctcaagtatgttcttttgtaggtttatggtcgttgctgaagctgcttctatttaggaatgtcttggaattcttttgggaaaatttttctaatactcatccaagatcttcactttcctttgtgtgtggacttgattctaccctgggaacagcctttggcatagttgatcatgccctcctttttgaaacattctcttctcttggctctaggatactacactctcccgggtttacttcctacctgtctggtcactcctgttccccattcaggcttatctccctctactcactaaatactgcagaccctcaagtctctattctaggtctgtttctccttccactctttattctttcccagggtgatttcaccaacaggcccccacgcttcaaataccatctgtgtacatatgactcacacatttttgcctccaactctgacctttaatttagagctccagatcgcatttttgactacatactttgctggagtatatctcaagctccagttgccctagatatattttccccctaaagctattctttttccattgtgtctggaacccgtaaacattaccaccatccaccctatcgtgcaaagatttgtggtcatccttgacagttctttctcctttattccccatatccaatccatcaacagattttatctataactatttcaagtaattgtctcttttatcacatctgcctatcttcactgtcatcacctgagcctaagcaactatcaactcccatctgaatgcccgcagtagtctcaaaactcatttcaccaatccactttggttccacactaaagctggaatgatctattggaaatacaaatctgaccatatcattgctccttgaataacacttaaatggtgccctgtcttcctttggttaaagaacaacagccctcattgtggccagtaatatcctgtgtggactcattcatgatgccctcttcagcttctttttcatctttccctccttgctttcttgccctggttatactacatttcttttcttttttttgttttttaagtacaacagggtgcttgccccattaggcaaggctatttctcctgctgctcccatatgctgctttcatggtccctttgcctggttacagcctgtcttcctttggaactcacccctattaggggtgaattgctccaagaagcaatgcattttttttaattatgcaagtatctatttacaagtgccatgtgcttctctgttcaaaccttaacagggttcaagtttgctattactgattcttgatttattaattatattcccctacccccaaccaccactaattgtagactctttgagagcaggaactgttcctgttttgctcaccactgtatcaccaaatgcctggcacatagagggtatttatgatcacttactgaaggaatgaagtatgagtctcattagaccaagctaatagcattgttcctagagtaataggatcctctctaggggctctttgccattgcactcctagtctctagaacaggacctggtagcaggcacactaagtaaaattgggctgtgccagtgagtgaatgccccagagacaacccttcctccaaatctaaataaaaagactctatcaatattgaggaaatttggatctgagattctccccttcctttatgcttgctacattgtggattagccacatctcagaaatcatgtctccagcctgggaaatgggggctgcatgggagctcctcagaaccagccctcgtccccccatccctaaatgtcagaccagccctgctgaagagatggtggccaactctttcaggaattctctgggctgtagatgagaagagtctactcagtcagccctggaatttgatgagttggttttgccattagcttgtgaaaggaatgaataaaattcctcatccagaagtccttctaggaacagaatctctgactctacagacagcatagtttagcacacagcacatggccactcaatggcaaaataatgaatgattgaatggataaataaagtccacaactgtggttcactcaccctcatattatgttataatttatctgttaagcagcaatgatgaggagggaggcctgtgctagacactggcattagagagatgaatagggtgacttaccattctcactagagagacttggccaagtaaacccaacatgtctaagttacaacagcttggggaaagtgctctgagagaggaaacacttaatgctcttaagcaaaaaaaaagggggtgcatcaatgtgctggagggcttaaacatcagtgcattttgggaatcaggaccatagcttttgggtagtagcattccttcaactcaagactctgctgagttctatgaataaatgactttaaaaaggagaaaactcaatttgcttccatgagaacaaatgtgtgtgggcagagacgtcatccttttagctaaacactaaacaaccacaaacatttagggagccctattaccagtcagaatctgtgctaacatgggaaaactaagataaacgaggcgtaatcttgcccctgaggagtttgcagaccactggaggagacagatgtgaaaacaaataactaataatattggtgcattgtagtaaaagatattgtgaggcatgtgcaaagtgttataaagtgttaatagaatttagagaagagggagaaactctcccaggggcacaggctcagagaaagcgtattggctgatgaagagtgagctgatgtagatgtggaagaaaagaaggaatgagttaggaagaggatggtttggactttaagctgcttcccacttaaaggctggcgccaataggaatataaatagaagcaggaggaaattcacttcgggtgctgataacccctggactactctctagaatgtctgaaataagatgttgcctctgatccctagtacgtagcatgaagatactggttcttggcattctttgcctgcttactttgttatggcataagcagaatggttgttttagggagaagggattgaggaactagatgacttgaagggattcagggtttctgaccactgaggtctaaaattggaatcaggaaacctgtggaattctggccctgacctttatcagccatgtgacttttagcaacttcccttggttttctcatctataaaatgggaaaatcagtatctcgtctacctttgggaatgtttgtgaggactgaccaggccagatccatgaagttacccaggatagggctaaggatgtatagtaagtggccagtgacctgcctcctctactgaggattgtgtcagcaagttaacacctggtagagcatgttgcattagtattaaatgctaaaaatggaattgatcagatttaagtgtttttttgaacccaaggtgtactcaagttcccttgaatatacaaactttttgccctaccatttgttccctataaagaacaaaacaaaaacctctttttatctttaaaaatctagttatttaaattgtgttgccccaaaataaagctgttatttccaccatttacctgaaagaataatgtagggttaggtataattcccagtgttccatggtttgatcctagagacaaagcaatatgagagaaaaaaaaatcttaacttgatttgccttaaggaaaagaatgcttcaacacagttgcccaagtgagaacctaaggcaactcacttaatttctctgcatgtcagtttcttcatctcaaaagaatctaatgataatcccaacctcacaaggaattggtcctcagaagttattaaatgggacaatgtatgtgatgcccttagcacagtgcctggcacatagttagcactcaactaaaggaagctgttgtcattatgatgattgtctagtcgcatgtttgggtgctttcaacattgctatccttccctttcccttcctaggtgcctccacccagaattctaacactgtggagccagagaagcaggtggacaacaccgtgaagatggctggcgtgatcgctggcctcctcatgttcatcatcattctcctgggcgtgatgctcaccatcaaaaggaggtgagtctctgctgctgcctgcaagactctgctgacccgaggtgacctcaacactgctgtgtggccaggtttttgctctgttgatcattgtccagcagggatcttctgttataaccattgaggtccggaaatacatgggccggctgtggttcattgtgttgctgtttgaagggtgcatgctgcctgtttggcaggtggtcctgaggtggccattttcttatgggccagtgatccctatgactgggccaccgcgatgtgccatgggattccacgtatcatgaattgagtcttataggagttaactgctgtgttgttatcaatcatgtcatcaagatagctcgggagccccaggaacatggatcagtccagaaacgcagttgcaggaaagtaatgttttaccattctcacctccgtttgcccctgatttccactggtcaaataatagcatcccaggctgccctctccatgagagatagagtctacagtggtgtgagagttcccaattacaagtcctattacaggctctgtactatgtcctgtcccacagaaccttcccagctgggttgctgttgtttgtcacctctcaaaagcatgtctccctggactcctttggccagctactagtttgctcatactgtgtgttttctccagttgcatttctcacgaaagcatgcacacagattcctcccttatttccaagatgtactacaccagcatcctctgtttaagaggcattcacaaggcttgaggataacacaaggaaattacagagggaagaaaatacaaagggtgaatatcagctatccctgtccacagggtgcactggttattcctctaaacagagagtcttactcgcccctctccttagcccctgcctgccaccatgttaacacatctacttcccacctccacgtcttctcagtttcaatgccagggccccaaccttagtctctaccttcccactcctcagtctatcatagcaaacaaaacatttatccacattataatactaggtggtgtattgtgccctgctcccaggcaaaagagccttctacattattaaccaaaccaacacctcagcctgaagctctgggtttgcttatgcacagagttcagggcaaccccaagaacaagggctgggaacttgcttccatctataggatgaaaaatgctcatcaaatgtgtttcctaccagaacaaaggaacagaatacccctaacaactaattccagctcctaccttaggaaccacatgaatataaaatgaagaattttttaaaagcaatatccccatttccagcaatcagtgatttagaaatactagggtccccactacacatgcagtcaaccctctcttggctatgcaagccccaggatgtccctctctctctttctcctggttctgctttggatcaaccatactagcctctggccagggcattaaactgtgaggacatttcttcttgacatttttctgtctaataggatcatgtcttgcctcaagctcccagcacaatggcttaagagctaaggttctcctccatctactgattttctggttggagaaactaggggtaacagaaggtattatgttaatattgggggtgaatagccctcaaagggttaaggtcaacactacattgtcatatcaccatcatcactgataacacatggccacattatatgtcccagtgactagtctgctgctattacatagggtagtatatgacttttgatttctctgggagcagtaagcacattgtacatgtaagatcactgaaatgtttcttagagttacagatgtattagaggcagaggtgaaatgtttcttagagttacagatatattagaggcagaggtgagtttgggattgtccacccaaattaatggaactgaatacctctttgatagacctgaaattttattattctttgccactgatttgtaaatcagatatgctcttccaattttgctctttctaaagcctggcttaacccacgtcaccatcatctgtgagattgtgaagaaatttcacttccttctcacagctatttctgaaatgtgtgagtgtgactttttgggagggaggaaaaggctttatgtttccagggtaggagcaactataaaataagtcctttgtggtagttttaacctcctctgagtatcttcatcaactctcatgtctatcaaaactgtccatcagacccaatcaacaggcatcacatgatcaccatttctccccaggaggcaaaacctgggcattgcatgttgtggggtgctaatcagtgtttacatatatggcatcttttgaagaaaataagacattttgttggcctagttgattggaacagtttacagatgggaggggagggtaggaggagaagaggagaaaatggggaggaagagagaaattgaacataggcctgcactctttccactaacctacaatgtcttcctgtgtctagagatgccccaaaggaaagcgaaattctgtgtacctcttctgtccccagctaccccccagctgcatatatatatcaatatatactacactgatcaattgagtctgctaccaacttactgttggccagaatactgtctacatctacctcaaaggaagatgtattcaagtcaaagaaacttccaagtagcaggctcatcaccatagctcaggatactagtgttaacatctcctcagtgtcctatcatcacctacagtgcttggactcagaagttcacagaggccaacactgctacaacccctccactggcttaagcttgcctgggtcttctccctgccttccctggtcatggacatggttactttccggggttttttttctgctcctaatagattcagctgactcaaagcccccctaaagctataaccacagatgtttccagaaacataagatgtccccagcttctccctctgaaggtttgtgatcactgactttagagcttccttgccactgtccaaagagagtctttctcttcctgttaggggtttccttttatgacacagaactagaagacagacagagaatgggcttgagatccatggatgaagggaagggtttaatgaaaaaagctaaattaatttatatttagacacctgaatacaaaatagaggagggaaaagagagaatatcaacaaaacttgagaggtgttttgttgttgttgcctggttttgttttgtaacggggggagggagatcttgagaaacgaaaaggagaaagggatatgagatgttggtgggtgatttaaatgggattctcttatagtttgaaagagaagcaagttaaagtttagaattctttttgcattacctttggctgtttgaactgggctgtattgaatgtggaaccatatggaattaggattgcatggacataaacaggatgatatgagcattataagaagggatcctggagcccctcactgacagagttaactaccagtgtggttttagccacaccaactacacaatatccatccttctgctgtcactagatagtggctccatctttttcctctggatctgtcgatcacatctagagttctgaatgttctgtaatgggtaccccatgtcattatgtagtaaaatgtacctccttttcatgagtaccatgttaagtcctgacataagagaaagaccttcatcactgactcagcactgcagtcctgatcatcttcgtcccttgcctcctccccttagaactgttagacatcctccccactcctccaaaaccagcaatcaagaggttgcatgaccaactctatgttttcttaacttaataccatggggcactgtgtgcctttaatgcaaattaagatgaaaagatcaagtattattgccttaaccagcatgtctcaatagttgaaagtgttcattagccactcacatatgagaaggtctacaattcaatgtttgtttgtggagcgtgaaattatatgtatgcgcacacaagtttcatatagctcgattttatcccttgggacacacttcctggagtctgaacatggtcccttaaagctcaaagcatggccatgcacttatgcatagggaaacaccaaagccaagttatgcaggacttttcacaagatccgcacccctggacttgcctggatcctacactaacccgtccatcacattttaattttcaaatgagaactaggaaattttagggaggtatattcaaagttggtaccatccatggttctagccagaccctgtctcctcccctgctcccctgcccagctcgtcctagtccagccttaaccttttgccaaactttccttgtctgtccaaatggaaacttctgttccaagagtgtatttggagtgtcttgagtataaatatgaatgtctattctgatattttatatgcatctctggttatacatcaattctctgtgacttgtacctgccctccagtagctctcagtctaatgggacagagaatcagaaaaactggccccaaatttttagtcctgtttatttgctgtcaaccttgcagaagcaacttaacaaatcttagcctttgctttcccttctatgaaaggtagccagttttatggggctattctaaagatcaaatgagctaattattgaaataggctttgttccctgaacctgcttaaggaattacaatgcacaatatctacagaaacattcatctccacatgaccatcaactgtaccaggccagctccaaacccgttactaatatgctaatggcagggttgcaatcaatgctcacacactgacataatttgcatcatttttcatttaaactgcagctatactctgattttaatattcctaataatcatagtaggttaggtctgttgcttgtttgaaaagaagaaactgaagttcgaaaagatcacgtgagttggtgaacgttttgggcagagttgatgtggaaacccagtctcagtgtctctagagctcatgctgctaccttctactctgtcagtccatggagactgacaggaaataagcaaatcctggactaagaaacatgtgactcagattcggtaccactttcctctctggggcttgtttttcccaatttcgctattttcttcttttgagcatgctgtttccctgaatgaaatgtcctgagatttctcttaacctacaaagttcctatcacactctgactctcagcctcttgttcttcctagtaggactcccaaatgttaccatctcagcaaagcctttccaccagcctcctgccccaggaagatccagtgatgttcctctgcagccactgtgccatacatgctagtcttcatttgtgtatttatcacactacccggtggttgtagttttgctggcctgaagatcagtcttctcttgttagagctccattatccatatcatctgcccctggacatctaccttgaaaatccctcaggtatttcgtagtcaaagtcaaaatcattacctactccccaacctgtttcccatctcattcacaggcactacctcctatcccatcaacaaacagatgggattccaacacccaggattctctacattctcttggtctcattctctctctctctgtctctctgtctctgtctctctgtctctctctctttctccccctccctccctccctccctcccttcctttctgcctctgcctctgcctcctcttcctccattgtcttttccctgggtcagacctctatagccctattgcatgagtttcctcactgaccttcctaactgtgccccacccctctaacctatcctccatactgtagtcagcattgtgttaaaaaataaagctcgtactctcaaacctgtcatctgaaacccttcaatggcttcttctccatagccatggttcatgaggtggaagtgagggaagaagtacatgtctaagtcacctggggaactttgtcaagtgatactgtctccctgcccatatggaaacaagtttcttagttcttcttagctttttagtttttctatttttttcttagtttttctgacaagtctcctaaagtctcacctctgctccataagttttgcttacgaactttcttcttcttcaatgcctgtgtttctcagctccatgtgaccagctattacccatgtttaaggactaattcagtaggcactttctcctataaacccttcctgacctttgatctggacagaatctcttcaccatctagatcccctctgtgaggacccatgttattttctgccttatacttttcctttgtatttgcatcccatttcctcactagaccatcagctgtctattctgattcatcttcatctccagtgtgccttgcaaatactgagaatttcctaaaaacatgttgaatgggagagcccagtggaattagaacagatcaactctctatggattatacaagagagcttcactcagagaacagacctaaatgtcaacattaagcattaatggttcgtgcaccaagtcctgtggtaggagggtggcaaggcaaggctggaggcagtatgtggaagacatgccatggtctgagccttcagagagcacattgccacaaaattttgttttgttttgttttgtttctgggtagacaatcagaaaagctaactcaggccaagctaaaagagcagtgcactttattaagggtactacagatcagaaaactgaaatggaaatagagtttaaggaaattacctggaatcacatacctaataaatggcagagttgggtctcaaacttggacaatctgataatggagtccacactctgaaacatcatctaatctggattaaatataaaacaggacctgctgagatgccaaattctgtggcataattttgagtgatttatcgaggtgggaaaaaagcccaaacgcccaaacaaaatgtgtcatcttctgttcatcctgttctaaactgctccttcctctacacctgaaaattgaatcctgctccttctgcttgcactcacgtggacagccacttaagctgagaacttggaagtcttcttcaatacattcacatttaatcaccttttgattttgtgtcttaaacaccttgcacactgctgacctttcttccccatcccatggccactgcaaaggaagcccctggtatttcttgtgttggccagtcagtgatggtgtaaccacattcactctgcctttgactttctcctcaccctcctgctaaaaataattcacctacaagaaatatttggccacatgacttcctgggttttccctgtgacctatgggactgagaccaagctgcttaaactctttgggaactagcccttccaacatcttgccattcccactttgttaacccacctgcccaaaccacaaacacagttccatctacctaaaaattcccttcccctctcctccatctgacttctcttttactttaccactcaggcatcccagattttgggccatcttgcctgctttccctcctcactcctatccccaggtatggactgacagctccatgtgttgccttatcatacaatttatcatgacagaagataatacaatgtaatagctattaatacaggctctttaaatcagactccctggattcaaatccctgccatgccacttaacaactatataaatgtgagaaagttccttaacctctctgagcctcactttactcatctgtaaacagggataataatgcctcataaggttattgtgaagattaaataaaatagttcatgcaatatacttaaaacagtacctgacacatgattgatctcccagtatttaagtgacagctattatcatctgctttataatttgctagtctggctctctcatcagacatatggactagattaggatctcatatgtctttctatctgtacttgacagagataaggatatagtaggcctttgagaagtttctgctgaattaatgatggaaagatggataaatggatgatgggtgggtggatggatggatggaatggatggatgcatgcatgcatgcatgcatgaatgcatggataggttcatggatggatggatggatagatggctgaacaggtgggtttgtgatctagatggatgggtaggtggttaaatgggtggttagatagacaactttgtcctgtttaaattgtatggaacaaaagaaaactgtgcctgaagtcaatcttgtgagctagctgaaaaaaggttctgcagtatgtgatttattaagtttggggttattgttttgttttgttttgttttttctaagcacagctgtcttcctgctcaggatttttggtttcaggcaatctgttacttgcaatatcactgtatccttgtaaatttagaccttcagtaaatcttcttcaaggcttagagaaaaacacacatgtaaactgttttggtcacagaataaagacctgtgatacttgacctagaagactttgcagtttaattgggaaaagagattcaattaatagaagtttgtcagttaccattatcctggagttgccttgctgctgggtcagagatagcacgagaaggcttttggtgacacccaggataactcagaaaagcaacttggaaaaggtggtctgtggtttgaaggtgaagaaggaagcatgttttcttggctcaggctgaggtgaatcctgaaggttgacagcagaaaaactagaaggtccagaatgctcagtgtagctgaggaggaggtggctgctgacagtgagagcatccagctcaggatggaggccttgcaactggtccaaagatacacaaagcctttgacctagtgaggcatggacttataatcttagattcctcagctaaccgtgagagtaattatatctgctcctcagggttgtggggaggattgaaagagataacgttttgacatcccagtgcctgactccccagatttctcaagatatatccattttcttctgtccttgaaagcagcacaggcttgaggtcaagaacatgagctatgggctgggcacggtggttcatgcctgtaatcccagcactttgggaggctgaggcagatggatcacgaggtcaggagatcgagaccatcctggctaacacagtgaaaccccgtctctactaaaaatacaaaaaattagccaggcgtggtggtgggcacctgtagtcccagctactcaggaggctgaggcaggagaatggcgtggacccgggaggtggagcttgcagtgagccgagatcacgcgccactgcactccagcctgggcgacagagtgagactctgtctcaaaaaaaaaaaaaaaaaaaaaaaaagaaagaaaatgagctacaagctttatagccatgttgctatcaaatccagttactagctgtgtgatctgaagttacttcttgtttgcctcagtgtctccatcagaatagtgggaatggcactaattcctatcttttagagcaactgtgaggaatacatgagttaatgtgtgctaaagctgagaacaatacctggcacacagtaagtgctgaataagtatttgttcatattttattattcctaaagaggtgaacactttgttcctggtgaccagaataagaagcagtaaaccttatctctgtggatgaggtgcagacataaaccaccctttactgagccctaatacattccagatgtttagattaatataatctaatatcaatttagattaatggaatttacatagaatactttatatattacatatcatatctaatgtgagtataatttagattaatataatgctaatgcctatggtgattcttgggaatacataattattgtccccaagcttgagatagagaaactgggactcagggctgtttagtgacttgttcaaggtcatgcagttagttaagtgatggtgctgagatgctaaggcttattgtatttccactcctgaaagctgtttgagctgtcggtcatctatgccatccaccttggtgcatggatcaggaaatagaggtccaaagggaagaagaagaacttacttgcccaagatgtcacaatgagcaattgaaagatctgagattataatgctggcctcttgattctcagctcagtgttcttgacaatacagagaacacaggtgtcctataagtcttcatcaaatggaccctgagttttgtgtcccaggggaatcaccttccaggcactggacctgccagcagtgaggtaaagaaattatctccttacagtgctaacgtgtatggctggtgaaggggatttgatgactttctgtaggagcttccaattcccactcattgcagtccccagtccttcaccttctcatcatctagggtcactgttctttcagtccaggatattgaacagttttctatgtggccagatcttgctgcactgtggctcattttccctagctcagccccctaaggaggtatggggctttccttcttctgtggcttcttaacttttagactcactttccttctgggtgtgtagggttgggctttgctttaggagtgatgcagctctgggctcatgtcccgcctctatcatgcactggttatagagcctcgggcaaattttctaaactttttgattctcttttctcttaattataaaacgagggtaatggtgcctgactcacagagttgctgtgaagaggagatgagatgatgaaagaaagactagagatagccccatcttgggagttttggatatttcctacttgagatgggaaaatttggggctgtgaagacgtatcccccactctgcagttataacgactgtattttcctgtaccaagcaaatgggataatggttgcaagtaatcaaatagttcaagaaaaaaggaaaccattcttgtctactcagatggatatttggagacctgaattatctagccatttttctcaatctataaatgtatcatttattgtcagtatagctgaatctgatgtgaaataagaacactcctatttattttcttacaacataagaaaagttataacaaagggaatatcatgcttttatttgagttttgtgattgcttagaagccaggagccagtaggaacattggaaagagattgaagccagtgatttttgaagctttcttttggagaatggaattctcagccatatgatatcttaaatgaaacttcaaagtataaaatagataaaacttcaatatataaaataggtgctttggtggatggtggggggcagcagcctcacttgctcagtaccctccttcttcattacacagtggctgctatagaacccccagacttctgtgaacacagttggaaaattactgatctagtttaatggacctaagggacagatgcagaaatgaaggaacagagagtttattcaaggtagagtctgttcagactgaaggttggaactcctctctctcagtacagtgctcttccaagataaggttggactttgcgccggtcatctactgccatgtaacaaactacccccaaaatctaatggcttaaagagcaacagttatttatttttctcatgtgtcttcactttgggcagagcttgaagggaatgacttatttctgttccgcaatgtcaatggtctcagctgagataacttggttggctgaaagtaaaatggctgggggctggtgggacatttctttctttttatgtagtctcagaggctctcctgtgatctctccagcatggtagcctcagggaaactgggcttcttctatggagactgagggttctaagagagagttatggacagagctgagaggcttcttttttttccccagcttggaaagtcccagaacataattcctaccacattctattcacacagggtcagtcctgactctgtgggagggcagtccacaagggcctgaatactaggaagtgcagatcactggggagccatcttgggtactggctatatgatttccttgctttgggtatgaccttactaaatagactctgatgtgactttatctgaaatagaggagacagaagaagtttggtgttgcttagatcacaggacattatcatagggaagagtggtagactagtcccaggaagccacagagagctgatccaataccctcacctgcaccccgccgaccaaaaaaaaaaaaaaaaatcataattacaaggaatctagttttggttgaccataaggaagaactttgaaccaactacaacagccaacatgaaacatggcttactctatgtgagaccatgggtttccctattatagaagaggtctctcttgtttcttctaccactggaaatatctgattctcagtgaagatgattagtagaggaacttgcatctccttgagcttagggatgctgaaataatatgtgcatttctaagaatcaagatttcattaaaaatctaattcttgtttgtttgtcttttctttttcccccattttggacatttccttcatctgactgcccatcaatatatagaagaaatgcttattcctactcctattacttgtaagtatcgagctggtgttaactttgcttcgtgccctgtaagggaacctgtagcatgcatttcctgcaccaaccaagtgtctgttagtttctcattttcacttctgtctaagttgtctgtagccttaaagtttttattttgcataaatgtgttacatttgaaagtgcactgtcattgttcaagttcgttatgtttccaccatcttggatttttttcctcttatttttagagatgtgaagggctgtttctcctttgtgagtgtaattttctagttaggaatccctgaattccatcaagcaggggaccaaatcctgctgtaggacttgcacacatgagacagaatcacagtcttagcaacttctaaatccatgtgtttttacttggagaatgggtagccctgggggctcaaagtttagaaaggtattcattggctgtttatgctatttcagaaagtctgcagggattcattactttatctagaaccggcctcacaggtgaaagaaacatccagtgtctttgctttgggttgggattatgtgtttggtgtttagcattatttatctcatattatcagtgcattttgttgggagttatagatgggtgcttgcttatccatttttttgcacttgctaaaaaaaagtgattatttttcttattaataaaacagagggccaggtgcggtggctcacgcctataatcccagcactttggaggccgagagggcagatcacctgaggtcaggagttcaagaccagcctggccaacatggtgaaaccccatctctactaaaaatacaaaaatgagctgggcgtgatggcaggcgtctgtagtccaagctacttaggaggctgaggcaggagaattgcttgaacccagggcggaggttgtagtgagccaaaatcgtaccattgcgctccagcctgggcaacaagagcaaaactccatctcaaaataataataataataataataataaataacaacaacaacagagatgctcaaaacatgatagtaaaggagaacaactctgtacagtagatccttggtgataaaaagttagaaagcccctgaactagtccacattcctaatatgcactttctatttttggaaattgagaggttgtagggaccttagaaagagattgaaggatgtgaattcattgaacatccagctagcaaaagagtgggattaaaacagagaatgcctggcttccggtaaaatgtattgcttagcgctccatgtcttccctcacctctggcaaactcagctttatgagagaggctgtgcctaatagcattacctgctgaaggcttcatagataaagatggagccagcaaaaggcctccccatcccctctgctcagtgtggggtccacaggtctttaggacgggtactaccaccctcatgttatatgggaacaaatgggcccccatcaccaatactggaagtaccagatcacttattcattcatcccacaaacatgctttgaacatgcacattatgtttcatatggtgtggatgaagaaatggctagaacccagaggttcagcctcacagtatgcaagcctatctgagagactagcataacgtcacctattagaaacgttagctgagagatgcctctacatactgtagtacaggaacacttagttgagtgatgaattttttgtgtggcaggggataggtatcagtgtattcagagatggctttacccattactgaaaaaattaaaattctgattagaggaaactgcatctgcaaagacacggaggtacgaaacaatatggtgtgtcattgctatggtggaaagagaatgagcttcaggagtgacgcagctctgggctcatgtcccgcctctatcgtgcactggttatagagccttgggcaaattttctaaactttttgattctcttttctcttaattataaaatgagggtaatggtgcctgactcacagagttgctgtgaagaggagatgagatgattttgtaaagtgcctggcacaaagttgacactcatgaaatattagttttctttatttcccctttcagaaaccacagggttcatggcaggaatagtagtccctgggagcccctctcttcttccagggcctcttagggtatgcatgtttcacagcagatgtgggcatacagggacccatcaccacctctggcatctaacccccatccctctatcagccagtttgcctatcagggtctttgaatgcccactttatacagtgctgtgtgctgggtgctggggtggaatccaagataagcagtgtgaaaggacagaggatggatctgcacatacttgcagttgaaggtgcaatgataaacacaggcctttcaattggtgcagacatgaagttctgtgccacaggtcccagagcaggaagctcataccagcagtgggatgcagaagcatctggataggacacagggtttccataattatattcattttatattcaccaaccccaaggcccccatgacggtcatatattgtatgccactgcaaatagcctgccttctatacagaaaccttaggtggttacatttcctcttaagcaccatcttcccatcccaactaccaccaagcacttgtgatagatgaaccagttgctagacttaaagggatcgaacaggtaaggtatatttaatcatttatacaggaggggagaataggaaaccaccaccacatgccaagtagtctgtacatacattagcccactaagtcctccgaatagcctagtctggtaggtaccattatccctatttaatgggaaagaaattgctctgagaagctaagtcattcccccaaagctacccagaagtagatgggagggagaattgattatcctggaaatggagacgtcttggggtgagaaatggtcatgtgagtcatatgcatatgactctggatatattgcagtgagaatgctggtggagctcccaagcaaaagcatcccatgggaacttagaaatgcagaagtggagtctaggtaggacgtggatgtttggaaccttcctctgagaggttgcagatgagagtgccaggtggatgaaagcaggcctggagaaaggggacaagaacagagggctaagggctaggggctgaggcccaggaactgaccatgattaaagaatcagaagaggagaggaactggcaaagcagacagacaggtaggagaaaagcgtaaggcccaagagaaggcttttgcagcaggaggagttggttggccatagcagatgctgcagaggatggagggggtgggtttgggcacagcctggacatttggccatcagaagtaacttgtacaggttgtagggatgaaggttgaagaggtagccagcctgcctggggaccatgagtaggatcacctttcacctttttttttttttttttttttttgtaaaacagagaagaaacatgatactggctacctgaaagatcagaaagtcctgggcaaagatttagttatagtggaggagcctgggcagaaggaaggggctgaagatactggagttgggggctatggaagtgaaggactggaggcgaggtgtttggggacagggaacagtctgggagtgggggaggagggagaggccttggagatgataggattgagagagagccatggagatgaggaagaggaaacagaaaggaaatgatggccccccatgtgctagtatatgccccgagggggagccttgaagcctcactcttcagtgtgtggaccctggaccagtagcatcagcatcacctgggagcttgtcagagaggtagcatcaagggccccagcccagacccctgaatcagaatctgcattgtaacaaggtcgcaggtgattcatatgcatgttagagaatcactgacttaactggagtctcagttgtcttatctataaaataggaaaagtaataccctcctcataggtatcaggggccacctggtccttttaatgaataaacactgatttcattgaagtgtgctctctcttcaacacactttggctcaccagtctcttcaatgaaatcagtgtttattcattccaccaatatttgtggaatgtcctctgcatgctaggcattggacaaggttctgggtatataggagttagcacaagtaaaaattcctgcacacgtggagcttttttagtagaagaggtagaaagtaaacaacatatataacaaaaataaatagtatgtagtggtaagagctaagaagaagaaataaactagggaaagaggagataaagtatggatgggggaggagcagaggaattctatatttcccccaaaataaagaggccatcaagtgctctccatctttgaaagtatccctacatgagaacagtggtccacaaatattttccataaggagccagacagtaaataattttggctttacaaacccttgtgttctgtgttgcatctactcaactctgatgttgtagcatgaagtcatagctatgtgtttgaatgagtgtggctgtgttccagtagaacttaatttttaaaaaccaagcagtgagccagatttggcccacaggtcacagtttgccaattcttgccctagagttttgagcgtaggaagagtgtgacagtcaagattcatcctgtcttattgagctcctgccatgtactttatcccgtgcctgatgttgcaggcacaaaagtgaataaggcgcaccctataccagactacaaaagggcagaagttgaaaggcattaccagttggtccctactatatatacttacccaatgcttataacaagccctgcaaagtatatgttattttgttgattttatttagatgttaagactgaagtctgaagacttgtctattgctcacagccagaatgcagcagggttaagtttgaactcaggaccacatggcccacaagccctacccattcttcttactaagccctgttctttgggagatgggggcacttctgcctggaccacgtgcttggagcacagcagccaggttgaagaagagccaggtaccaaatgcaagtctgtctgcctgtagggcctcgtttctgtgcatggccatcagtgcccttctaggcataagaagtggtagctattccaggctggtaaggaggccgctggggcagtcctgtctctgctgtcctggggattggccacatgatgtggctggtcttccaagcagtgctgtgcacaggcaacatgttgagaggagtcagagctgagggcactgagctgctgcatcagaggtagccaaagggttagagcaagaggttatgaaaggggtgttaatgaccaggataaataacagcccaataaaaatggagctatggaacagagggatctggggacccagggacacaggatagttaaagataaggcccattattgtctctccagtatacacgcacacgcacacacaaatgtgaatcatgtgggttttggtgtcaggcctatttcacaattctaggtttgcctctcctgtgagattgtttccacctggaacactcatagaaacactctgagcctcagtttcttcatctggaaaatcatgataatagcggtgacttcccagtgttttggtgaagggcaacgagagagtgtatatgtagagtggctggcacacagtaggtattttataaatagcagctactattcctcacattctgagctgacaaaaatgcctctctgggatccctttttgcctttctgtagtaaagcagaccccaacaacttcagttgttcagtgtttgcctttttaaaggatattaagagttggcatgtgtccacaggttaatttacctcaaggtgtgtgataggcacagtaattgttttgaacagaggtattttactgtagtagttcttgagaaagcgcgaaggtgtttaccaattgttctggctgagagagagcacgtaactacttcacttagccttggacaaatgccttgtgcagatgtctccgaggcagaaaaccgtgacctgggctggtttctgtccacagatactccatgggactcctgggcttttctatagccttctgatctcctccatctcaatatattcaaatccgatatcattcttcaaagtccagatcaaacactgccttctacaagaagtctctcatgattctctccacctgtgggaatggcgcctttctctgaactgcagttgctttatgttatgggcaggagcaaatttgtcttaaggatgttgcttgctcattagggtattctccatggaactcctaacacatgcagtgaaccccagtaagtgcctgtgtaatgagtgaaggaacaagatgaatttaaaagacatacggacatacagctaaagtcaacagggtggtactctgttcttgaaaagaaaaaaaaatgacatcattttttagataactctagaccttgtaacttccttgcttctgtgggtttaaggccatttttgcttctatttttgcatctgtgtgacctgaacaagccactcaactttttctgaatctcagttgcctggtatgtaaaacagagacaaaaaatacaaatcttacagaagaagtctcacaaagattcaatggacataatgtaaaatgcctagcacatagtagggcctcaccaaaataagagactgctcctttcttcaaaggcaaatgccttttcacatcatcagctgctgtgaagcagatatcattgcttcaatatatttaaacaggcattttaaaatgattccatcaagagatactcaaaagttatttaatgtaatttatcagccactttgaataaaaatgaagaaaaaataggaatagaagaaaaccatttaaagttgctaaatatcaattactagtaaatatcaaattatcaacagcaaacatgttaataggtgaaaatgtaagacattaccatgcagtcaagactaaagtggttactagcagtgtggctcttcagccaagaggagaaccttggtgggaagtctgattcctgagcctcaccccccagatctgctcagtctccttaaaagcatggcctggggatctgctttttaacaagtatctcagattcttatttttcctgctgactttgagaacaactctcatggcatcctcacatcactctgatttaattgtccctttcataatgtttatccctgcagtgaattcttcctggaattcttcctatcccccttgtgtgcccagaaaactccagtatctttataaagggagtgtcattgttctctactttggaggccccctccaatttccatggaccatatccatagcgctgggctcatatctttgtcgttgcatttatctttcattccttcacccattgacttactaattcatgatcccttcccaggttatcctgcccttggcatctttgcatgtcagtctccatgtagggagaactatgtattactcatcattcatttcccagtgactagatcagtgctcaggacaaatcaggcatcataagattgtgttgattagatgaatgaacaaagatacatgagtggttatatgtgtggagttgatacccttccaattttgttttgtctctcattgagttatattattctattctctagaagttagttaatatccatgttcacttattttggcctacggtgatgatagagctttcagatcacctattttgtagtcttatatgggttttaggtttagaaatgttgcattggtacttgcatgacacaattataaatgtgtaaaattaatgactgctattacaatgagatattaatagatataaatgcactgggctagaccatgtgtactgatagatttggatagggattgcaactgaacggatgctttattgtttactctattgaactggcgtctaaacgcatcagtcacgcatgccaaacagagcaaatctgtaagtcagaggctctgtcactttaatcaggaaaaatacaaattttacctccaaaggtggcaaaaggtgtttatatttcagttataaatttatacctaagtttaagttttattatgttggtgcaaaagtaattgtgttcattactattttaaaaaggtaaaatgtacctttaatggcaaaaaccgcaattacttttaaaccaacctaataataccaaccaggtattagtgatgtcttgaggcttagaaaagactgtctgtgactcttaatgcttctacctcataaacatacttgaactttataaacaaggttaatgagagtatggagattctctgctaacagaaaggagtaccctactgcagtgtggttagaaagaaaattcctgtggaggactctgtgatgtgctgctcagatccaccttcaagaatgagggggctgggcgtggtggctcatgcctgtaatcccagcactttgggaggcccaggcaggtggattacctgaggtcaggagtttgagaccagcctggttaacatggtgaaaccccgtttctactaaaaatacaaaaaattagccaggcatggtggcacgtgcctgtaatcccagctacttgggaggctgaggcaggagaatcgcttgaatacaggaggcggagattgcaatgaactgagatcataccattgcactccagcttgggcaacaagagtgaactccgtctcaaaaaaaaaaaaaaaaaaaaaaaacaatgagggactttccccattcgctacaattgatgctgacagatgcctatgaaagaatgatcacccaaggaaaagctttttagagtttttgtattatcagtgagcaacaaactaatgaccccaatcggtaggcaaagtgttcataggcaatgaagagtgcatttcaggggagggaaacccacttgtttgtgacactaacagccccccttcagaacttgccctttggagccgcctcactcaaagtcatctactcactggttgacacagggtgtaaaagcaaccccagcttcagggcctcccctggggttggctttagccactgctccaactgcatcaccattcaacctttcctctgcccactccctttctttttcccttccctttccttccctccttctttcctcttcccttcctcctcttccccttctctcctcttcccttttatctacaggtgaagcttccccaatacatctcctgcttgtcaatctctctcagagtctgattgattttcagagaacccagcttgggactctcccattggcttttctggagacaagtgggtttcccaccactgaaatgcactcttcattgcttatgaacactctgcataccaactgattggggttattactttgttgcccactgataatacataaactctaaaatgtttttccttgggcgatcattcattcataggcatttgctgttcacctgtgcttgtgctggacctgagagccacagagatcttcacacatagctcctgcttgggggagctgaagatgtatcacagagaagaccgtagcaatacccttttgctgatccagccagaggagagaaccagggtcagaagtgcccagccacagtgcccacttagcaatatgtctccaaggcaggattgggtttacttccgaaagcactaccttcagcaagcatcccccaaatgggaaggactcttacagctagagctgtagcaaagatgggatcctgagatgcacaaactggaaaatgcctttctaagtgtttcaaaatagtgcttttaatggaaggaaatgctttagttaagcccctcaatgttgatgatgatgctaatgattgcattttgtttgtttttagggatttatctcttccaaagtgctttcccacttattacctagttgtctagttaagcttggaggtatttcggaagtcattattagatagatgactgtgccaagcaggaaaaagccctgagcttcctggctccacagttttagataactcacttaattccatctcaacttcagtttctcatctgtaaaatgggagtcataccacttacattttacaatagctctgatgtttaaatgacatattatttcattcataagcatttgctgagcaattcccttgtgctaaggagagaaaattgttgagtctttagtaagaaataccctctcaaggagcttgcagcttaaaaggaacttgaacgtgttaataaaacgttacaaaataatgttacaagtgcatgaaaagaggagcagtgaagacataacaaaggcaaggaagtcactgattctattttgaggaaagataccatgggttaacgggcccagtaaagtttttggtataaagtagatgccagatgtttccttaaagaaatgacacatttggcctggtgcggtggctcacacctctaatcccagcactttggcaggccagggcaggctgatcacttgaggtcagaaattcaagaccagcctgaccaacatggcgagaccccatctctactaaaaatataaaaattagcctggtggggtggtgcacacctccagtcccagatactcaggaggccgaggcagaggaatcgcttgaagccgggaggcggggtttgtagtgagccaagatcgtgcagctgcgctccagcctgggcgacaaagagtgagattttgtctaaaataaataaataaaaaatgacacattcattcacttttctcctcggcctcataacattgaaacacacacacacagaaacacactttttttcataacttaatttgatagcatgctaggaaaaaaacttaaaaaggcaaagaagtggaagaaaggaatgctatagagagggaaagaaaggggtagggagaaagtttgaatcctatttatactacttagtagctgtgaatcctaaaccctctgaggttcagttttctcatctgtaaaatgggaatggtagtgttcaattcatgggattatcttaagaaattaatacagtgtacttgccaggggaattattgtcatttatgaaattatagagctaggctagaacaaagcagtggtttgatatattggagggagggagagagagagagaggagagaggagagatcaattgtaactagcagatataggttaagtagaagaagaatttgaaaatagaatgaagtaggaggattttagatggtgttccttaaacttcacagatttttcccctccaagcaattgggtaagacaaccctcctcctggcatccacccgtggtgatatcaacaagaaagaaaagagataactaatgattttggctagaactacaaaggaagacaatgtcatttttatacaagaagactctgtagaccggtgggcagagaaagagctggggttgaatggggtcgggagagtgcactaccatggccatttccaaatataagggctgggggacaggcttgtttattgagatgtggctggcaacaccttcctttaaaaaggcaaggttgtcagaattcgagagaggccaccatattctgaacaatgccattagaaatgttgcctttctgggaacagagcttagaggagttggtgtatttgcgggagggcactcagctagggagaagaccccaagccacagtctataaagagaggttggagaactgacttaactggtcaggggtagtgcctagacattttaaagttccccaggttattctaatctgaaaccgtagttgagaaccacccatctggaagggcttgagaatccagggctatcaaataaaggcatttgaaagagcatcgtgaagcattagcctggccatttggcccagaaccttagttgagaatttggtcccatacaatcatcagataaacatgagtttgagtatgatgatggaacttgagtttggaaagtaaaatctgtagaagtcaagatgctatttggtggcatcatttccttttttaggtattgaggtagacaatccttagactgttcataaacgtacagaggtcatttaataaagggcaaaaatgccctgagcacatacgtttgaaatagtatttagtttcttgcaacaatcactactcatgatggttttggaggcattatgaggagtaaagtcacctccaccatgattatctcctcagaaatgtgtgttcagaagcctctatccctgaagcctcaagggactcaatgcttctgctgatgaaatctctttcttaacagaataaaagaacattggctgagttgctttctggagcagttttttattctaagggctttgaaccacagtgcagaacattctaagagggtgggaattggtgggtatattacaaccacccatgttttttaagtggaagaatggaaagattagtgtggtcaaaaccctgtttttaatgaaagacttgatttttgtaaagattgtaaatatcgttttattaatgttgtagaccaaattgagcctcgagactaaagaaggcttattctgtttgggaaaacagcttagcaacaatggactttttcagaagtggagaaaagctaagtcttcatacttcatttcattcttccttccccataccaattttgatttgggaatctaccagatgagaatttttggtgaaaaatctaagctcatatctggttggtacgggatttcatattattattttttcttatctttgctttatatagcagagctaccatgaaattgtgggatctaaggtttttccagatctgtggctgatttgaagtatacacattgactgttttactgtgatgtgttttccagccatgtaggcaaggggcaatttgctcaaaaattgtacttctgtaatctcatctttcattccttaagggcgttaaacagtgcttttgccttagctctgaatggtgaggaaaacaataagcaacacctggaagcagcattgtagcgaaaagagcatggactgggttggggtttgaatcctggactttgccgcttactaacttaaattctctgagcctctgttctctcatctgtaaattggggacaataacaccaaatgtgggctgttgctgtggggatttaccaggacagcataagataattgaatgcatatacgacatctggtttttatatctggcgcgtagtaggtgctcagtaccttgtagttattattagtatattttatgttttatattactctgtctactgctgttttgcagtttaccaagtactttcacgtaagtgttgtgtcaagaaaaactctctcacactgcattttttctctactctcacactaccacagtcatcaacatggaagagaatttctgtgaccaaatgtatgggatgttttccccacacatcaagcagcggacaccagctgggtgtcctacaattcagttcctacctggagatagtgtcagatcccacaggttaggggctcagtccccatgactgttccccattccccaagacaccagtcacaagcctgggcctctgaaatttctgtccaacaggcttcaagttggggttcccacaaccccttctttgggttcaactaatttgctagagctgctagagcagctcacagaactcggggaaacatgtttaatggtctattataaagcatattacaaataatactgatgaagagacacatagggtggggtttgggggaagaggtatggagcttccataacctccccggggcaccaccatccaggaacctccacgcgttcagctatctggaagctctctctccaaacgcagccctcataggttcttaggggagcttcataaaatcagcattcctccccctgggtatgaggtgggaccctctcagaggaaggtcttaagacccacaatcagaaagacaggggaagatgagagtcctgccttggggcaagtgaaaggaaggaaggagagagggtgtatcacctgaggccttcccctgggccctaacacacccaacattatagcaaaagactgtaacaaggaatatgggagttataaaccaggcagagtggacaaatccaatctatatattgcatgacaccacaggtatctcatgaaatctttgagtcactccaatgaggaaatattttaaatgtaaggaaatgaagtctcaccacactgagcaggggcacaggtcatatgaaggaagaaacccgtggaacaaagatgtgctaattactagtgctgtgttctcatcatgaattgagggtggctgtggcagggattctgaaagaggctggtaagtattacagcccctgccccagagagaagcactttacaggtctgagtgcaggggaaagatgcaatgaaagggtccaaagctagcccttaccctttgctctaaattacaatagaaaagatgaaaaccaactgatgtggtttggctctgtgtccccacccaaatctcatctcaaattgtaatccccatgtgtcgagggagggaatgggtgggagctgactggatcttgggggtggtttccctccatgctattctcatgatagtgagggagttattgtgagatctggtggttctaaaagtcgcagttttggccaggtgtggtggctcacatctgtaatcccagcactttgggaggccagggtgggtggatcacttgaggtcaggaatttgagaaagcctgaccaacatgatgaaaccccatcactactaaaaatacaaaaattagtcaggcatggtggcatgcacctgtggttccagctacttgggaggctgaggcatgaaaatcgcttgaacctgggagttgcagtgagtggagatcatgccgctgcactacagcttgggtaacagagcaagactctgtctcaaaaaaaaaaaaagtggcagtttcccttgcatgctgtctctctcctgccaccatgtaagatatgccttgcttcccctttgctttctgtcatgattgtaagtttcctgaagcctctccagccatgcagaactgtgagtcaattaaacctcttttgtttataaattacccagtctcaggtagtatacttatagcagtatgagaatggactaatataccaaccaaataaaaaattctaccaactagccagatgcagtagctcatgcctgtaatcccagcactttgggaggccaaggcggatggatcacctgaagtcaggagttcaagaccaccctggccaacatggcgaaaccccatctctactaaaaatacaaaaatgagctgggtgtgatggtgcatgcctgtaatttcagctactcgggaggctgaggtaggagaattgcttcttgaacccgggaagcggaggttgcagtgagccaagatcgcaccactgtactcatagcctgggagacagagtgagactccatctcaaaaatcaaaaaacagaaaacaaaaaaactctaccaactgtatcatttctttaaatatactcactgtccctaaaacaggagcaagatcattcgttgtttcacaattggtatgaaatttatcatctacattggagaaataggaccaagattaaagagaggatacggttggggtcacgttcattgttttttaaattggcctcttgagtcctgcttaaacttcattgagtaaatttttgtctcttaacgtttttgtttatagtatcctataaaaagggttgtaccttggagagaattttattccaatttagttatagcagacatacataaaaaactttatttaaacaatgtacctaagtgattatgatatttatacataacaatgtttcatgttatattttctggacatgtgcggtttagaggctttttccccattctttctttttattaatgtgttttatttttattattttatttttttgtagagagggtgtcactatgttgcccaggctggtcttgaactcctggcttcaaacagtcctgcctcagcttcccaaagtgctgggattacaggcatgacccatcacgacctgcctccctgttcttttttggaaataaatgtacaatggcattttagcttgttgatatccgcaagcttgttaatatcctgctgagtttcgactgggtttgcattgaatctgtagatcaatttggtgagaaatgacctcttaacaatactgagtcttccagcttaggaacatgtatgtctctttgtttgattcgatcttctttgatttctttcatcaccattttatagtttttgtcatgtaggtcccatgtgtattttggtggatttatatctgaatgtttcttttttgggtgctactgtaaattgtactatttatgaaaattcagattctaattgttcattataaatacacagaagtgaaaccgatttttatatgttgaaaaatatatatatatataacttttttaaaaagataagaaaatagatatctcagatggggaaataatttcgttactcaaaaaaggctactgcatgaacgatgtgttaggctgacccaggccaggtgcttagcagtgcccaatatgtgctacatgtgagttctcatctgtcttgccttgtcatattctgtattgctctaaaagccaggctccatccaattaatggtagttacaggacttagaaccatgtgatagttaagctgtcaagccctggcctcaggcagccccgggtttggatcttggccctaccatatactagctgtgcgatcttcagcatgtctttcacaccctctggtcttctttttcctacactgcaaaatggagataatacatgataacattgtaacttgaccagagcccagtgcctggcacccagcaagcactcagtaagcattagctattctccttcttgtctttgttgttgttaagttataaggaggaagaggctagggaagtctaaggaagaactctctaacaatgcttatctaacactgggtcaggttgaaagggaagtggtgagcctcctatcacagaagaatggacaaccccctatctagaaaggcgcagggggagtcaggcttccctgagagttgctctatgtgttgagattataacacccttcatagcccacatggcgttataagcagaactagtttccaggtctccccagtcctctcagatacttgacccacagacacaaagtgtttgaagcagtaggcagaaatagtatccctgaaaaaacaaacaccgaccagacttatctttccatcagcggcagtttatgattgcacattaaattcaattgcttttctttaggaggctggtgcagggacccgtcatctctaacccagtgccatccattctagctttccccaggagcgcagacagaccagccgccttcctagtgtacactaattaattaatctcatgcttgtgattttatggcgcttaagtgctggagcatttctgtttattcttctccctgcaaagcacctcacgttgcataaagaccatgaatctccattgcaaacgccgtctgtcttgggctggagaacagcccaccggctgtctgttgtcttgctggcactgcctcttacagccaaagtaacacatccattaatttatccttaatgacattttgacatcccgatcagttcatcagatgtttcttttgcaagacttgtcccacacagccgggccagggtgctaggccactcttgatgcataatgcatgagacagtgcaccgctcagtaccctgtgacagacagatgccatctgctactctaagactgtatgttcctaatagccctggctcccagagtgattcacaccaatgccttcagagttgttttcttctatgcttccagctttctgtgcttgggagaagctggtcagtgcaaggagaggggcctggggtcacaaacatacatgcaacagtgctaataggagggaaagtaagggtaaatcaaccccttgctatagtcagagtttagagaagtcttcattctaattcaggtggaagaagggcctagggcaaacctaacatcttgaatcttatcattactctgctactacttagaaattaggatcatgaagacactctgataacaataatggatatcaaagaagaaaggaaaattatccttaatatcctcaatccaacacatgagccatccgcacatagatatacttcttcatcgttgtaatcacaatgtagacacatttttattttctagtttttttaacttaatgtaatccagttagcatttttccatgtcgttacatggttttcatttttaatggccctccatcattttaatggctgcataatattccatccaggggatgcactataatttactgaaccagttccctattgttagacatttacgaggctttaaccgatcatttgctattaaagaaaggcagccaagttgggtgaggaggagagcatgctctcagcaggctgaagagctaggctcaaatcccacctgttccctttacctgttttacgagtttaggattaacctttctgggccctgaattcctcacctataaaacaaaagaaataatcactaccttgttagtgttgtgaaaatcggagctatgtttaaaatactaagcacatggtagtatctgctaaatgttaaactgttacatttacctaactatgccagtagtaggggcaattctgcctacccaaaaagaaaaccattttgcaatgtctagagacatttttattgacatgcctgggagtagggggaactactggcatctagagggtggaaaccaaggaggatgctactaagcatcccgcagtgcactaggtaactccccaacacatacgtagcaaataattatctggcccaaaataccaacagtgctgaggttgagaaatcctggcatagaggaagctgtgtttccagtggtacctacatgatacatgtatattttccttcttattatttccttaggataaaattctagaaaaatgggaattgtggattaaaggatagatggtcttatgcccatctacagttttggggtggagtgggggatggacgtaatgttctgtgtgtgtgtgtgtgtgtgtgtgtgtgtgtgtgtgtgtgtgtgtgtgtatgtttgagagtctcactctatcccccaggctggagtgcattggtgtgatctcggctcactccaacctccccgcctctcaggttcaagtgattctcctgcctcagcctccccagtagctgggacttcaggcgtgtgtcaccacaccgggctaatttttgtattttagtagagacgggatttcgccatgttggccaggctggtctcgaactcctgtcctcaggtgatccacctgcctcagcctcctaaaatgctgggattacaggcatgagccactgcgcctggcctggatgtaatgtttgaggtgactgatgaagaaaagttggaagataaatggtatgtgatcccctctggggcagaagatggcattccatagaccagtagttctcaaaatatagaacctagcgtctcctaggaactcggaaatgaaaagtttttgcactcacccctgatttaccaaatcagaaactggtgatggagaccaacaatgcctgcttaacaaggtgattctgatgcacactcaagtctgagaatcattgccatgcactacctgcagaagaaagccaacttgtagaatagtaagtaggaccctgcttaaatacagaaatttggtgcagaaattgatgaaaagggtcaagtcgtagacacggggaagctcaaatatgggacgatgcaacaataaaggaatggaaagtgtcactcaatttattcattcattccataaacatgtttaaagcttttacaacattgtgggaagtgctaaactatgtgctaaaggaaatacaaatacaatacgcaaatatgtatattttgtaccttgattataatgaaaagtgatgagagaagataggcaaatgactgggatacaaaacagaagcaaggcctaccctatcacgaagagatcagaaaaggcttcctgaaagaagtgatgatttgaatgggatttgaaggacttgtgatcatctcttaatatgttaattcaacaggtctttacaggatacccgcttgttccaaaatctatgtaaggccctggggaattggtagtgaacaaggccaacaaggttgttgtccttgtggttatagtctagcagggcaatagccctgtaagttagccattcagcaagaaggagatgatgtttctagttggcaactgaaggtctaagatggggtcagggtgagaggaggcagttgtgagctggtgagagggagatcaccctggagtcctggtttgagatctgagaagaggtgtgggcatgtgagtgtggaacggagaaggaggttcactcagctgtagggaaatagccataaagcctcagcaaccaggagacgctgcttggaagcggttgcttgggataaagcttgaagaattcatggtcatcatctatccacatacaggctttgttgggatatagcagacagaccgaggaggagcatctaaagggtgaggccttcaggagacagagttcagctcagcctcagctcagcaaggaatggccctatatagggagctgcagtctgttaaagagctgcccacagaggtgatgagtttgggttgctggaattcagcagtcgggggctggatacccactggctggggatgctgcaaggagtctcctagctagggtgggaaaatgactgggagggcctttccagccagagaatccaagattctacaacttttaatgatgtgaaactgaaggtcaacgcatgaataggggaagagcatctgccccactggctggtttggtttcgggtcgtatgagcaggatatggatagagcaagatgaaactacagggaggaaagattagtcaccttggttccctagagtgctcatcttgggaagcagatcaaacataaaattaaaaatgaaagcaaggaaaaagtcatgcggattgctggggcaaggaaggaggataaaaaagaactagcatttgttgcatatctttatatgccaaagaccatgctagggaactgtcatcatttatcatttctcatcatcacagtaactctgcaaattagggtatattaaattctattctatagacgaggaaattgagtctcacagagtcacagaaatggagacctgatcatgattacaccactgttaggagccaagtcagtccagggccagagcccatggtatttctgcaacaccaagaacagaggggccatctccccaacccaggggttcagagctcagacagcattcattcagggaagctcccattgtctgaaccatgaattctggtcacactctgctttgaagcacttttttctttcttatcacctattatgtaacaaatgcttatgtagagcttatttggtaggtgacagatcccagttaagtactttcataattataagttagtatctacctcaaagcattgctaagagaattcattataattatccctatttgacagaagagaaaactgagttatagggaggtttagcaattgcccaagactatacatctaataaatcatggagccaggatttcagtctaggcagtgtggctccaaagtcagtgctattcctaggctctgctttagggcccaggggccagtatggccatgtacccagagggaggagggcctcacctgtgtttcgggctttctgctgctctgatttcactgctgggtgcagagaatggtccaacagggtctgactattgcctaagtggaaagagtgtgattggtaggagagcccatccaggccagagaggtagtcacaggcagaataaagaagcagagatagacagatagaggcacagatatggacagcaagatagcaaagcaatggaagtagaagaccaagtcctttggcctttcaaattgtcatgacgtctgttgctgctgctgttgctgctgctgttgcttctgtaactttgccatgctgggggattcacaagccctagatgagggtgatggggcaggagggaaaggacccaccagctatgccccagaattggtacccaacagaggcagtgagcagacaggatgctcattgcctgcaggacatgagtggttgtgagtgagttttctggccgcagctgtctatgcatgtatgtgcatatgtgtgagtgtgtgtttgcctggggagaaagggagacagctgagaaagctttaggacaaggggagatatgtgatggctttttgcctaagcgtgacataacagggaatcttagagaacatttagaagcctgactggagggtttgaatcctagctctgcctctgaaagcctgggtggctttccatgggttacttcaactctctctgcctcaattcttttatctgtaaaatggaactaataatactcctggcctcacggtgttgtagcagaattaaggaacttaataccctgtttataaaggccttgaatagtggctggtattcaataagtactctataatgtttattaaacaaataacatcaatttaggaattatggtcattttattagtttcctcaggctactgtaccaatgtctcacaaactagatgacttaaccaaaatttgtcctctcataattttagaagctataaatccaaaatcaaggtgttggaggggtcaggctccctctgagactctaaatagaatggtgccatgcctcttcctggcagctggtggtgcccaccagtcctccgtgctccttggcttatggctcatcactcccatcgccacctttgttgtcatgtggcattcttccagtgcacttctgtccaaatttccctctccttgtaaggacatcagtcatctgggaatcagagccaccctagtgacctcattttaacttcgttacgtctgcaaagaccctatttccaaataaggtaacattgacaggtactatggattaggacttcaacatatcttttgcggccagagagtgggtgagtggaacacagttcaatccataacaatcattttaaaagcatcagttgttgccatgattcttagatgccaactcccccactatagtgaaatcaatacacagagaggggaaagggagtgttcacggcaactcaatgagatatctggagatctggacccggcacccgggtctcttaccttctagtgttccattttcaagaatgaaactttactaattcagacctgctgaagagtgggcccacctacttcggtggttctcaaactttggcatgcagtagaattgcttggagggcttattgatcacctagagtttctgattcagtaggtcagggcagggccggtgaacttgcgttgctaatacatccccaggtgaagcggatgctgctggtccagggaaaccacacttggagaacagctgttccgcatcggtggtgctcaagcttagtggcacactataatcacctggaaagcttctgaatgcccagatgcccaggctgcaccccagaccaattaaattagaatctcactggtaatttttaaagctccccaaatgatgtgctcagccaaagctgaaaagcatggctctagactgcatcaatggaggtttttaaagaaaagtcattatccagggcatccacttcaaagtattcatatttaataaataatgaggttatttaaactaacatggatttttttgtatttaaaatatgatcataccagagagcatttattgagtgcttactgtgtgcataccctgggcaaagtggtttaccagcaacataccattcaatcctcccaacagtctgacgggggaagtactactctaatccgtgttttacaggcaggaggaaactggcatgcagagggctcagtaacttgcaagagcttgcacagctagtctgacatggagccagattttgatgccaggctgtctggcaccaaagccagtatattaactgctatgcagtcctgcctcctgatacgagggaaaacagtgcattctcctttaaatgctgcacacatccatatccctatttacactattgattcttttttttttttttttttttgagaaaaaagactaattgggtcatctttattttcctagcactagcatggtacttatactttgtgacttcccaacacattgaactcttttttttttttttgtcttttttttttttttatactttaagttttagggtacatgtgcacattgtgcaggttagttacatgttacatatgtatacatgtgccatgctggtgcactgcacccactaactcgtcatctagcattaggtatatctcccaatgctatccctcccccctccccccaccccacaacagttcccagagtgtgatattccccttcctgtgtccatgtgatctcattgttcaattcccatctatgagtgagaatatgcggtgtttggtttttttttcttgtgatagtttactgagaatgatgttttccagtttcatccatgtccctacaaaggacatgaactcatcattttttatggctgcatagtattccatggtgtatatgggccacattttcttaatccagtctatcattgttggacatttgggttggttccaagtctttgctattgtgaataacgccgcaataaacatatgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgatggccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgacggggttgtttgtttttttcttgtaaatttgtttgagttcattgtagattctggatattagccctttgtcagatgagtaggttgcgaaaattttctcccattttgtaggttgcccgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggtttccttctagggtttttatggttttaggtctaacgtttaagtctttaatccatcttgaactgatttttgtataaggtgtaaggaagggatccagtttcagctttctacatatggctagccagtttacccagcaccatttattagagagggaatcctttccccattgcttgtttttctcaggtttgtcaaagatcagacagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttgggttaggattgacttggcgatgtgggctcttctttggttccatatgaattttaaagtagttttttccaattctatgaagaaagtcattggtaacttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaggcaattgtgaatgggagttcactcatgatttggctctctgtttgtctgttggtgtataagaatgcttatgatttttgtacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctcattgccctggccagaacttccaacactgtgttgaataggagtggtgagagagggcatccctgtcttgtgccagttttcaaagagaatgcttccagtttttgcccattcagtatgatattggctgtgggtttgtcatagatagctcttattattttgaaatacgtcccattaatacccaatttattgagagtttttagcatgaagggttgttgaattttgtcaaaggctttttctgcatctattgaaataatcatgtggtttttgtctttggctctgtttatatgctggattacatttattgatttgcgtatattgaaccagccttgcatcccagggaggaagcccacttgatcatggtggataagctttttgatgtgctgctggattcgttttgccagtattttattgaggatttttgcatcaatgttcatcaaggatattggtctaaaattctctttttttgttgtgtctctgccaggctttggtatcagaatgatgctggcctcataaaatgagttatggaggattccctctttttctattgattggaatagtttcagaaggaatggtaccagttcctccttgtacctctggtagaattcagctgtgaatctatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagttcatttgcgtagaggtgtttgtagtattctctgatggtagtttgcatttctgtgggatcggtggtgatatcccctttatcattttttattgtgtctattagattcttctctctttttttctttattagtcttgctagcagtctatcaattttgtagatcctttcaaaaaaccagctcctggattcattaattttttgaagggttttttgtgtctctatttccttcagttctgctctgatcttagttatttcttgccttctgctagcttttgaatgtgtttgctcttgcttttctagttcttttaattgtgatgttagggtattaattttggatctttcctgctttctcttgtgggcattaagtgctataaatttacttctacacactgctttaaatgtgtcccagagattctggtatgttgtgtctttgttctcattggtttcaaagaacatctttctttgtgccttcatttcgttatgtacccagtagtcattcaggagcaggttgttcagtttccatgtcgttgagcggttttgagtgagattcttaatcctgagttctagtttgattgcactgtggtctgagagatagtttgttataatttctgtgttcttttacatttgctaaggagacctttacttccaagtatgtggtcaattttggaataggtgtggtgtggtgctgaaaaaaatgtatattctgttgatttggggtggagagttctgtagatgtctattaggtccactcggtgcagagctgagttcaattcctgggtatccttgttgaatttctgtctcattgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatggccttctttgtctcttttgatctttgttggtttaaagtcggttttatcagagactaggattgcaacccctgccttttttttgttttccatttgcttggtagatcttcctccatccttttattttgagcctatgtgtgtctctgcacgtgagatgggtttcctgaatacagcacactgatgagtcttgactctttatccaacttgccagtctgtgtcttttaattggagcatttagtccatttacatttaaagttaatattgttatgtgtgaatttgattctgtcattatgacgttagctggtgattttgctcgttagttgatgcagtttcttcctagtctcgatggtctttacattttggcatgattttgcagcagctggtaccggttgctcctttccatgtttagcgcttccttcaggagctcttttagggcaggcctggtggtgacaaaatctctcagcatttgcttgtctgtaaagtattttatttctccttcacttatgaagctgagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataataccctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcctgtagctcagagtaatttgatcgtctgaagccttcttctctcagctcgtcaaagtcattctccatccagctttgttccgttgctggtgacgaactgtgttcctttggaggaggagaggcgctctgcgttttagaatttccagtttttctgttctgttttttccccatctttgtggttttatctacttttggtctttgatgatggtgatgtacagatgggttttcggtgtggatgtcctttctgtttgttagttttccttctaacagataggaccctcagctgcaggtctgttggaataccctgccttgtgaggtgtcagtgtgcccctgctggggggtgcctcccagttaggctgctcgggggtcaggggtcagggacccacttgaggaggcagtctgcccgttctcagatctccagctgtgtgctgggagaaccactgctctcttcaaagctgtcagacagggacatttaagtctgcagaggttactgctgtctttttgtttgtctgtgccctgcccccagaggtggagcctacagaggcaggcaggcctccttgtgctgtggtgggctccgcccagttcacccagttcgagcttccgggctgctttgtttatctaagcaagcctgggcaatggcgggtgcccctcccccagcctcgctgccaccttgcagtttgatctcagactgctgtgctagcaatcagcgagactccgtgggcgtaggaccctccaagccaggtgtgggatataatctcgtggttcgccgttttttaagcccgtcggaaatgcgcagtattcgggtgggagtgacccgattttccaggtgccgtccgtcacccctttctttgactcggaaagggaactccctgaccccttgcgcttcccaagtgaggcaatgcctcgccctgcttcggctcgcgcatggtgcgcgcacccactgacctgcgcccactgtctggcactccctagtgagatgaacccggtacctcagatggaaatgcagaaatcaccgtcttctgcgtcgctcacgctgggagctgtagaccagagctgttcctattcggccatcttggctcctccccctgctacactattgattcttatgtgatgtagctcagcctttgcctcaattacagtaattctgagtcagtgggggcatagatgaataaagttttgctgcatttgtaagacactggaatcatgtgtaccacagactgaatttgcccttctaatctggaagggcaaatccctagaagaagcatggaggaatgtggagcaggtgtccacattcctgaactggcaggcagaaagcagggcttgcatcctacatgctgtgcatcttagctaagggactactctgtccaggcctcagtgtcttgtctatgaaatgagaagatgctatagttcccttacagttgcgatgtgtaactttaagctgagatctagtcatgccagcagagcatcctggattcaaagaggacagtgccagcttttagtagaagcagggcctcacttgtgaattttttttttggtccacttcctatggctgagatctctgactccaggatttcaatcttcatggtttccaggaaagtttatctggagattgcaatggaggatggcccagaggaggagccctatggggaagaggaagagtgcctgatcagtgtctccccaggagagtgggcatggctcccacattcagggaaaaactctaggtggaaccctgtagactcctgcccccaccagttggctggatggtcctgttcctagcccagaagagagtcaagggttttgcagagtccaaatcctgggatcctccaccacctcttttctaagtggtttcccagtctctacttgaacttctccaatagcagggagctgagtacttgcaaaagccaaacagggcaggattcctgtcttgtttttcatatcatcatctccttccttctaacagccacagattcaacgtacttgctcattaactatttgtccaacaaattaatgagcaaagaggagggaacttctaactttgggaaggaggcaaagacttctaagagtaggggacatttgagttgggccttaaaaggtgaagagaaggttgctaaaccagaaaaattggggaggggaattcaggcgttaggtgcttccaaaagagacctaagcagttctactttgctagaaattccttcgttgtgccatgttggtgtgctgcacccattaactcgtcatttaacattaggtatatctcctaatgctatccctcccccctccccccaccccaccacagaccaacatggcacatgtatacatatgtaacaaacctgcacgttgtgcacatgtaccctaaaactaaaagtataataaaaaaaaaaaaagaaattccttcgttgtatcaagccaacctggtcctcattctgcccctgggaccatagagacccaaccatcagatgcatgaagagaacgttactttgtattccctctccgtgagaaatgtccctggatgtttcacgcactcctcctctcgtagcatgatttccacacttttaacagcccttcattcctctcccgtgagccattctacctgccagtatcccttgtaaagagtggcactcagaacaaatcacaggactcatggtccatcctgggcccatcccctgccacctacccctccctcagctaacaagcgaaggtcagagagagctcaaagtgatccgttagaaggaaaatgccaagagctatggccgcgtcacctcgtcctcacctgtcagaagcagtaaactttggattgctgtgtcttaaaacagtcttcagctttggaaatgttcctgcaaaggaataaacagacttatgcatactctctttttatcagcttttggtaccccctgctggcgaaattgtgtgacccagttggcaaaaatctcaaagcaactacagaaaaaaatcctcagttcagaaagtcataagtacttgagttttgaaggctctgagaattccatgaattatatgatcatcccatgagtcatatgactattgcatgagattttttttttcttcttcaacatgctatagctgcagctattttgtgggctctgcgggggaaatctctgactcccatgaatattttgttaattctgcaaacattccaagaaggaaatgctaagttaccgcccaaaatatttctagttacgaatattccaggtcaccagctaattttatgcaggcgtttccttctctttctttgcacgtatctacttttaaagtggttgtaatttgtgttcagagtaagaggactatcttttctagactccaaattgcagacttttaagtataaattcgtgcaacaagtttattgagccatgtgccagacactcagcaagaaattggagtaggtgcaaagagtcaaaagccctttcccaagaagttcttgtcgtagtaggtgaaagagttgaatcactgcaatttgactcaacaagtacgtagctaacatggcaccaaaaccctccctgatctgctgccagggttcaaaccaggttctagctcttacatagcaacaggtatttcttcttggtgttcatcgtctttgtgatttttgtctctgtatttatctgtttaatgcccgtctttgccattagtcttcatgttccatgtggattaaggtcaagaagacatgatcttctagtatttagcagagactcatacatgtacatgttcaatggatgagtcaagcaagaggagaaaattataattctatgtagaagagcagggagaagcctcagaggagatgtgacacttacattgagccttggaggacaaagaggaggtgaccagtggagaagaagagggacacatcaaggaatatggagtattgagaaatagtgtggtgggaggaggtagttgatgttttctgaaaggggaggataaggttatgtgcagagaataagactgagttgaagcccagtccttagtttaagggtcttgtttgccctattcacagatttgggtttctctttcgttgagagagaaaaataatgaggtagtaaattaaattatttggctatggagatgaatgtcaatttttctgtgttactgagaggtctttttaacacttaaattcagaattctgaaagaatagatatagatccccaaactgtggttttgtgttttatttccttccacaaataccccctccatttccaccttgtagctgtctttgccaattgccataacatctatccatacattaaaatgattatataacattattatcaccatgaaaatacagagtcagccatcagctttaaatactaaggatgtaatatatctgatatttttacaattcagttagctttccaatttttaaatatgtgttttggggatgcttagtttttctttttttaatacaggtgttcagagctacccaaacatttctataaagtaccatttttcataaaagcagcaaggctttcattattattatgattcctttgaaaaccaatgatctgtgcctaagacaaccctttccatattactttaccctgaatggaatgagattggttgagagttctgcccctaaggaaatatcaaagcctccgaaacatactcatttatagttttaagttaactctcttatcagatttccttttatttcctgctggggcaatgtgagcagagctcagatagaagcaaagaatctgctatatttcttttcaaatttatgattaagaaggtcacatatacatttttaaacacactcctttttgataataaatgaagaataaaatttcaaaatgtcatcagaagcagaattgctcatttttctttcgttggcattcccccgcccctgtctaattgtctgaccaatccaatgcttcatttcttgttgtatatctgcctggaatcattttactggtagaacagtgtgcctgtggccaaagcattataatgaaaagatgcattcctcttcctgagtgcctttctttccccgagccaacttaaaaaaattagtgaataaagaattccattttaggctacatgtttctccaaattatggccaaaacgagacgtataaagaaactttctcggctgggcacggtggctcacacctgtaatcctagcactttgggaggccaatgcaggcggattgcctgagctcaggagttcaagaccaccctgggcaatatggtaaaacgctgtctctactaaattacaaaaacttagctggatgcggtggcagacacctgtagtcccagctactctggaggctgaggcatgagaattacttgagcctgggaggcagaggctgcagtgagctgaaatcgcaccactgcactccagtgtaggcaacagaataagacactgtccacacatacatacacacacacacacacacacacacacacgcaacttttctcttcttggttgggattcctggatccagttcccctttccacctttctctactgtgctctctgcttccagagtgcattctgtatgaagtctgtcaaaaagatcacttgccacttctgacttgttgggttcagctagtgagaactgccacaggcgaccagaggaagggcataaggtgtagtcagggcattttttttttttttttttttttttgcctctggttctctccctgtcaggttgtctatgactggctgggcctttcaagagaaagccgctgcttctgttcagggtacctccttttcacagctctcttctttggggctctggttactgcttcctctatttgttcctctggtcccataggtaataaacagctctcctactgaggcactagtatattatgggtccctatacatttgtcacctttatcagcagaccttttataaataaaccttcctcaaattgtcctcatttgagtatgccctctgtcattcttctgtgaagtctacacctagagcatgagattcatgtttcaaggaggatgctatcaaactggaatttgtcctatgtgaactcctctaaaacacttctaagctgaggtttgggtctttcttttcttttctgttttttgtttgtttgtttgtttgatggggtctcactctgtcacccagactggagtgcagaggcgtgatctcggctcactgcagcctccacctcttgggctctcaagtgatcttcccacctcagcctgctgagtagcacaggtgtgcaccaccacacctggctaatttttgtagagatggggtttcaccatgttgcccaagctggtctcaattcctgggctcaagtgatctgcccagctcagcctcccagcgtgctgggattacaggcatgagccactgttcccagcctaagttgaggtttatcctttccttttatacttcctctggcagggagattgttacctcttgaaactatctgtttcatgatcagtggggctcaaccttggaaaattattccctgtattgcactggatttgacctctctgggacagccctttttgtgtgttgagacaggacaggaatgaccaaaattgaatttgaagcctactgttgtgaaggatggagtaagagacttggagaaatttactctcaagatatctgatgtttaacctatagcctttcatgtgataagactataacagctatatttcgatgcatatatgttggaaaaagagggaccatgttcgctttttcgaaatatttgaataactcttatatgcaagaggagttagtcatatttttgtatctctaatgatatatctgagacctatccagttaaaatttaaaggacatagattttaaatccatagaaaagaactttttaactttttagttcctcagtgaggtcaaagtccacatcatttgaaagaattcagggagagatgggatcccacagtggggctgttggggagggaattccaacattagaatatagttggatccactggcaatagtagaaaaaacaagaatagcaactgctaggtgtctagtgtccactatgtgcgaggcactgtgctctgtgtattttatgcattgtctcatttaatcctcacaaccctataaggttggtcctgtcatctgccacagtatacagaagaatagttcaggatttagagtaagaaatttgccctgggtcttgcagctagttggcaggcagcagaggtaagctatgaacctgagtctgtctgacaccaaagctgatatttttaacctccagtggctggtgtcagaataacttggggaacttgatggccatgtagaattctaggtcctgtcctacttcaatgatcctgagcctctgtgtgtgtgtgtgtgtgtgtatttttttgtgactcttcaggtgattcaaatttacaccaaagtttgagaagcactgctctacactattattatcataatagttatattatgataatatccgtctggttctgagggtcttttattcccatgggaataaggttgcatcaattcagctctaaatttccttcttttgagctgtgaaactaacccgcacactcatccatttccaaccaccagcccctgcttcactctactattatttggtaggtttttgatgagctcagttcctgagaaagacaagcctccatttttaatctcattcagagccacagaaacagaaaggccagtctagccacttcctccctctgaaaggagacttagggaaaggaatacaaatcttgttgatttcctctgaaaggagagtgggggaagcattgtacaagtctcattgatttcccattttaggctcaaacatagaacacatgcattgtcgggggtgaggcagcagcgtgagtctcatatttctgagtaaatggaaaccattcatggtttgttctgccttgattctttttctggagaatgaaccagatttgggggttgaggatgagcattggggaagaacaatctacccaatgctttaatgcaactggcaccatctgactgtggttttttccccttgcacatgtcccaaaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcagtaagtagagccaacaaaggggaaggggacatccgtggtccagctcagccctagtacttctgctgtgaaccccacacattgatcaggtgctgccaggcatagggtatggatgcttgcctgatatggactgggatgaaggttctccctgacaaagacttggggcagttcatcctaagatgaaaaggaatatttaaaaaatcttccccaaatcagatggaaatgggagcaagtcatcctaactgcttgtggacataaatagagacaggttaaaaataatagcagtaaaaaagaaagaggaggaggatggttatgtccttaaggagaaaaatatgccacactgaattgagtggcttaagattttcaaatctgtgtttcatatacaccacataaggtaggtgagtcacagattatgactgtctccactctgagtggttaggaaactgaggctcagagaagcaacttatctaaaatacaatggctgatgagttacatatttagattggaagcctcatccctcaaacatttgccagttccaccacagccagtgttccaagtagcattggtcaagggcacctgagtccttgtgcagtgttaataaaggatcccaagatttgggtggttaagatatcagggttaacccttatcctaagaagaactccaagactgccaacatctaaggcttccttgtggacagacttgcttctgttcttacagccattctatcagacagttaacagactagatttcccagcctcttccccaaattgggtaatgcaagaagtctcaaagaatctgtgcataacacagatgtcctccacataccatgtaagctacaaatggaagaacctccattttgtaaaaaatcactcaagagatgatcagtttgggatgatggggatctatgagaggataaagaaagaaagaaaaaatttatccccttctataatgtagacactgtctctcatcctcaccatagtcctgtaagatccttagtattattgttcccattttataggtaagctatgcaatgctaagtgtgtttggccagccatctcagagccacacagcttgtttttaatggatccagatctgagagtaactcaggcccatgattcctaagctccagtgtagcacagaacctacctggggaggttttcaacacatccatatctggaccccacaccttatctcctgaatcaaaatctcctgggggatgagaggtggggcccaactgagggatatggattttgtaagtcattcagagagttctcataggcacccagatttagaatacagcacttggacagaggcaatagctatgcttagatactgatgtactgtctttgggaagagagattagtttaaacctacaaaaatgttgagaagacagcaaaatgaatactcatataccctttacctagattcaccaactgctaccattttgcaacatttgcacttttgcacttggctgtactcaccctctctctctttctccccttatccatgttttttttttcaaaattttctgaatcatttagaagtaagttgcagacatcatgacactttacctccagagaattcagcatgtatttcctaagaactaggatacctcttcaacataaccacaataaagtataaccttacttcagtgatctaatataccagttcatagtcaaattgcctcaatgtcctccaaatgttctctattgcttatttgtttgttattttaatccaggatccaatcagagcgctcacattgtatttggttttcagctgtctttatcctctttgatctagaacagccctctcaactttattttttctttcaggatactgactttttttttttttttttttttttttgatggagtctcactctatcacccaggagggagtgcagtggtgcgatctctgctcactgcaagctccgcctcctgggttcaccccattctcctgcctcagcctcccaagtagctgggaatacaggtgcccaccaccacgcgtggctaattttttgtatttttagtcgagacggggtttcaccgtgtttgccaggatggtctcgatctcctgacctcgtaatccgcccgcctcggcctcccaaagtgctgggattacaggcgtgagccaccacacccagccttgacatttttttaaagtctagggctgtcgtcctgcagagtgttccacaatccagatttgtctaatttttttcatcatgataacattcaggttacacattttggcaaaaatatgacatagctgatatgacgtacttccctttacatcctattaatggacatatcataccgctttgcacattaccagtgatggtaagtttgagttcttcttaaggttagataatggcttttaaagacaaagtctaatggcacatactgattatgagcaaatatttaacatctgtttttcttagggatcagagcaaatttgcggtttgcctaaccatgaagccagtcctttttttcccattttcaatccagataaatcactgagactcatacatttcctagaagcagggaaattggttgttgacatagaccagggttgacaagaaaatgggcttgatttttccttaaaagaaaggaacatcctagctataattttgcatctgtaaaccaacctctgttgcaaaattacaggtagctaggaggaataagttctaatgttctattgtactgtagggtgactataattaataacagtttattgtatattttcaaatagctaaagcagtggattttgaatgtttctaacacaaaggaatgataaatttagaggtgattaatatattaattaccctgattattatacattatatacatgtatcacactataccccataaatatgtatataattagtgtcaattaataataatagaaaaaaagagaaaggctcatcaggagctcactgagtctctggctatgctaagttgtcactggatcccctgctttcggctctggggcagagaagttcatttgcaagttcatctgattgaaaatactggtcaagtaataccaattcatccttttctgtccagtccagcctcttgtgcacttttttccatttgtaaaagtaccctgggaggactcttaaaagcaaaatgattatggccaaaacttcttgacaatcattgtgaccctgaaattttagatattggttctcaatctttctgatctcaaatgcaaacctgggtaatactgatttcttatgtttcaaaggataacattgtcactgttcgctatgggccaaaacttagacccttaagatgaaaacacccaagactgaaatagtttaacttgccataaaggaagaggagaaatatccagtgaaatctaattagatgttttaaaggccagggacaaacttttcaaatgattaaggtgtgtatgtatgtgtgtgcatatgtgttttatatttacacagacacgtaaatatacagagagaggtataaacctacacagtcatatatacacaaatatacatatatgactgtatatatgcattcatcataacaatattgctttctaaaatatttaaataatgattgacttattatactcaattattagaaaattctgcattagtctgaatcactgaatacgttaggactctctatgcatctgacgtcctcaggctacagctacaaaaacactctcaggatcttttgactgccctagaatgcatcaggtacctttaaaatgccctgtggaaccactgggatgagatttgagggggaaaaatgtaagtaatgcttacactggagatgagaaattgcttctgaaatcaccctgatgtatgtagaattgaatctatttttgtggcattagggaagtgactgtctggcctctgaatcggtgtctttaggaggccctgagattatgtacaaatgttgaggcagcattgagaggtagggcacagaatagttgttacattgcaaaagattacagaagaacgtgccttgagcaattatttcattattgaccaggtaggccctagcctaattcaaattctacctgtccctgcataggtttattttctggggttttcttttttcttttttttattatgctttaagttttagggtacatgtgcacaacgtgcaggttagttacatatgtatacatgtaccatgttggtgtgctgcacccagtaactcgtcatttaacattaggtgtatctccaaatgctatccctcccccatcccccaccccacaacaggccccggtgtgtgatgtttcccttcctgtgtccatgtgttctcactattcaatttccacctatgagtgagaacatgcggtgtttgatttttctatttcaagtgactgctaagttctgtgacatctattcaatcaaaccttctaatattgtataggaacaatgacctccagggctctagggtgatggggctttgtcagatatgggccattgctttggagtgccttggtattcttgaaaaaggagtacgtgtcacatttcaaggacaaacaacgtgcattgttttccatttagagaaatgctagcttttattaagtaatctgattttgatcttactgccctgtgtacttgttatttttctctgcgatcttttgctcactgggatcattttctgggtctttcttctggtgcttaaatcttcttctttatctcttttgttcacatgtcatcttcttgttcattttcagtccaaacaaaaatgcttcaaaataaattccttttgaattcctgtgatatggggacttggtagtctgctcttcccataatggcatttgacagattaacttgcctactgggtaccatgagttaactccgtcctgatttttatgctttccctctattgaattattccatgtctggaaggtaaaggcagtccttctctaagggtcatcagacagacactgggccatctagctctctgctaagtgtcaccttggagctgggatttaatggactttttctcagtacatgcctacccctgtgctgtaagccatgtggcacggtctggggagagaggtagtttcaaagatgaataaaatgaggtattgtatcacaaataatacatggttctacttgtaagcctttcatagtttacgaagtctttctgcaaaacgctccactgcagcaatagttccttattcctgtaggaataaggtagctagtaggtttttaattattcccattctacagatgaggaaactgaggttcagagagctttcatggcccaaatcatacatatattgcagagtcgtaatgagaatacatctctcctgatttcagttagagtctatccatctcattctgcaaagaatttggggatatatccaataaaagaacctacaatttaaaaaatagtgagaaaaataatcagtatcaggaaaatgtgaaggtcaggaccaggatatattgaaatataactatattacattaaaatgtaatctaaaatatgcactctgataattttaaattccactttggctctgggatttctagtagaaaatgcccaaagaagaagataacttttattgggcacctactatgtgctaaaacttatgctttatataaattccactctgaagctcccaaggaaccctatcattagatattattcctattttgtgaatgagaaaattgagcttcagagaactgaagtaaataagcccaaagtcacacaatgaagaaagagtagggatagaattagaagcaaataaggctctctgactcctaaatcagtgttccttctcctctactgtggatggtagcccaacattcaccagtctcacagaggaaggtcactgacagccgggagaaagggagaacttcacttccttactgataggtcagctggcttttctaccatgtgggcagaagctgctgccacagctgttttctgaacagaggcctgggaccaggtactggcatggagcctagcagattcccacaaggtgccaggtactatgataagcatgctcaaatatggagtcttagtcattctctcagtaaccctgtatagtccatatgattattatcgaattcattttgcagttgaggaaactgatgctctcagatattaaaagatcttcttgaagtcatatgacaaatagataatgggccctggaccccagagcagatattctactttcaaaaccaagcaactttgtctttcctttgacctttagcggtctctctaccatgaaggcgagtgaaggagagacaggaaatcaaggtgaaatagactttctggctgggagaacagtgcttcttactggttcctctattccctgaaactcctgcctcaggaaggcagctgccaagtggatgtacgcacagacaggttctgccggaatcatcctactaggaccctcttaggaaagtgggactgcagaccagtagtcccatccttacgcatcccaaagctagaccaatccctgggtagttatagagagagaggagcaaagaatggcccctgcctaacagagagcttgcagcctggcagtggagacaaatggttcaagaaagagaacctttgttacaggactttgtgcaatggaagcctacacgaagagccacaggaccctttccctgactttgtacctcccaacatgaccaaaatataccaggcagccagcacacagtcaccttaagaggtattttctgccaaagaggagggtggaccctgaaacctgatattcttcctgttctttaccacacagacctcataaaagggtttctttgtgggcagttcagagaatgttcaggcttggtactcccttgggatggttcagtagagatgaggcaggcagaaggaagtaccaggcaaaattttagccagattattttaggaacatgttatataactaaagcaattcaaatagggaagacggatcatggcttttaaaacaatagaggctggctggggtggtggtaaactctttgtaaagattccttaaccctttcaggaaaatggccagctggctgggaaatgggtctctgggaaaactggcctgaccctgatcttctctggcaaaaactcttgacttgatggtgtgtgatgtcaaggattgctacatttgcttgggactctctctgggtcagtcattttgctaggtgctgttcacatattgtctctgatcctcaaaacaatgcaaccagttaggaatcattatcttgatttcataaatggcataattgatgaccccaagctaagagctgtattaaacactgcatcctaaatcccccacccctcattgttgttgatcagtacataatgacagttgcccaactctctggcccatcagatactcattgagtacttgtttgaatatatgaatgaatgaatgatggagctggaattcacactcagatctagttccaagcccagacctggttccatcttttctcataatgtattctctcttcaattaagccaaaatctgtcctctgtaacttcattcattcctgcttttgtacacaaccatgtattagtcagcaaccacgtgctggcctttgtctgccctctggtgtcacacagggtaatggaatcagtgcttctcttcctgcagcacccacaccctccccagctatttgactgcagctacctctgtgcccaggtccttccctcaggctaaacagtcactgcatcagccatcagccctcctcggaataaatttctgtttttcagtctgctcaaaatctcttttgacccttctgtctccatttggtccatgcccacggaatgtgtggtttccaagacaaccatgaccctctacattgggctgagtcactgggagttcagagagctaccatcaccctcactctgatcctaaacctgggtttaaaatatatcactcatgttttaattaacctctaaatattcatcacgtgactgcctaatgtagaaatcatggcttccagctagggctgcctcagtcagcccagatgaagatgacttttggggcccaaatcaaagattttacattttgtctgttctgtttcttgttaggtttgaccctgcttgccaagcctacagggctattttttttttttttatttctggttgtgtcagccaatcacttaatcctcctagtctggggccttgaaatgtaggaattactacattgttaatatttatgatcctagttattatatacagagcattaattatatgcccatttacgtgctgagtgttttatattgtataagcattcttatctcattggtatggtgggaaaattaagtaagtgttatgattatacctgataatttaaaggtgaggaaacaggctttaaaatagtaaggaatttgcctaaggctttgtagctttaaatggcagagctggaactcaaacctaggtcagcctgacaccccgaggcccttagtccaagactactcctccatgctgccttctgtagatgttattattcccatttcatagacaaggaaacttaaggccacagacactgagtcatctgctcaaagcagtggttcttgaagcatgatctccagaacagcagcatcagcatctcctgggaacttgttacaagcaaattctcaggccctacctcagacctactgaacccaaaactctagggttagggccaagcaatcagtttttaacaagccttccaggtgattcagagaatcactagctcaaagtaatgcccaggactgtcagactcaagcccttcttctttatttgcaaagctgtctttcatgatagtagaattatggcctctctgggagaggaaggctctagctcacctccctgggtagatgaactaagaggttattgccataggagtactggacctgaagggtgctaaagcccattaatagttatgagggtccccgaatctgggaatctcaaccgtatctttgattttgtctccttttgtctgaacagtgaacaatctaagagtcaggatggaaggagtggaaatttacaaggaaaagcaatgatgagtcacacactgaaatcgagagctcaacagagcattgtgaaaaagaactcaaagatgcaaaaatcctgtttgcaggaacaattatattttcaggttgctccaagattaaattgaatctgggagaagaattgaatgttacaagcttgccccctccagttttattgaatatcttacaggaattattgaatattttgcaatcatccacttagctgacagattaaaggacacacttattaagttcctggcaacccaaagttgaatggaattgtttattccttagcagttacaaaatggaaatttaggcagccttgagaaagttgaccaattttccatcacaaacactaaggagttaaattaagacaagttttagagaagaatattagactcaaaaaagatataatagttatacataatcaaactaaaactaaaaattaccttagatgttattgatccaaacttctcatcttaaaaatgaacatttgagttgcagagagttttcccaagatcactcaatgagtcacaagtagaaccagctagaattgggcccgtggcctttaattagggacacgaccgttctagttttgtcccacggtacccttcaaaggaatgaagtacagtcaacaatggtttgtcttctatgtaatattttctgtagactcctaatctgatttctgcataaatagaaccttctcaaattgaattatacttttcatctcctggttatgggagtagctgaggtgttcctttaaatattcaatgaatgccgactctatgccaagcattttagggattgtaaagataaataagacatggtctctgcctccaatgatattactgtcctctaagaggagagttgtaagtggattagtttcaataaatgtgataaatgatagagaaaaggtgtgtatagtgtcccagaaacactgatcagacacccagcaagtgattaattctggctaagtgatttggaaaatacgatgtaaggagatggattttgatttgaaaatagtgcaagagaacagattgacccaggtggaaggggcaaaagcttggaaatatgaggtgtgaggtctggtggactcagagaagtgggtttgaagtccaagatactctgtgtcaagaatgtatggccagagacgaagctggaatggtagctggagcctccttggaaaggacttcacatttgtgtcccatttaaattcactttccaggaagggtaacctgcttgggaattggagtgatcccagtgtcagctgtccttgtgtgattttggaacccagcttcatatgctctttgagttgtatagatccagctttctattgtagataagcagagtgcattttatcagttacagaccttcactgtcattgtcagctggcccaagcattcctcaatacactttcaaagagacctcagtaaagttacaaggctgaagttgctttttgacaatttatcctaggccactacatcttgagaagaaaatagaattgttctctacacctcacaggtggtcttgaattataacagagcacttaaaaagtgcttgttaaagtaatcagggataaagaagtgatgttgacgatgtaaatatatagttgctaggtagcagaataaactgagcttagagaccaatttccccccctctgctcaaagctacagacttgatgagttgaaaacatagataataattctactagctaacattttgtgagtaattgctggacaaagcactttctatgcctcatttcatttaatattctcaacaatgctatgaggcatgttatggaaactgaggctcagagaacttaagtaacttgctcaaggtcacatagctaccgagaaaccaagcccagggcttgaacctagtttcacatgatggacctatcacgcagcccctccttctggaaacattttctttgcttgacttttgctctccttgtgttttgccttcctccccagccatttcttctcattcttctttactggttctgtacttgctcccaacctctaatcattgaagtgtccccggccttagccctgaagctcttcctttctgctcatactcactctaggtaggtggtgatgatgccaaatgagatagcacaggaaggggccagatttgaagcagaagagggggacatttacatctaggccaatcgatttgaggtgttattgagtcatggaagagatgccaggttggcagtggactctggggcctggagctcaacagaggagcctggcctggggatataaatgttcactgcattttgtatacaatgtgattggagactttgccatgaatagggaaactgcggcccacagaggtgaaactcattgcctaggatcactcagcaagttaatggaagaaccagaactttgagccaagacttacatataggaggacctatagaaaagccatcagttaaagctcagggtataacatcaaaacagtgggctataaatggggctgtgtaaatgtggtccaagtgcagagcattctggaaatcacctggatcctgggatggaactcagaatgtgtgaaggagctgatggattagaagaccccatcaatatctactcagctggattgtgataggatctctacattcaaagtagaagtttacggcaagaacctgaggtctggtttatgtattaatggttgggagtggatctaggaaagtcaatggaagagccatagggcggactatcacaaagattgaaaagctgcatgtgaggtagtagaaggaaatagcaaagggccaaggatgggcaaagcccctatgctcagtgcatcaccatttccataattctctgggttgcttcctacataattttgaaaagggttccatgatgtttagttactcagcaccggttgacttttagtgagatgctcttaactaggtggaaagaactgcccaccccaccagacatcaaacacatctcaaatctacactcacctgtagaatagacagatgttaagtgagcacaagattccactaaccaaaataataaccattagtagcataagaaatggcatttctactctcaaaaagcccatgaaatagggaacacagataatagttatatgacttggtatgcccagtagaggtgtgtgtagaagctgccaagagaatgttgtccagtgagggtgggggagctgtcgtgatccattaacctgtgattcatctctgttcagatgatttacttttcaccttaccaatcatatgagttgatatcctaattatatggggctgaaaatgaaataaaacttcaattccccttaatagcaaggatacattcaggagagatgtaacatagattaatcttgacacgttcctctctctcacctcccacatcgagttcaacaccaagttttgatgagtctacatcttcgatatatctagaatccatctattttcctctatatccactacctccatccttgtccaagtcatcatcatctcttacctgaataagatccacaactcctaaataatcctcatatccatccgtgtcattctgtagtctattttttcataggagccagggagaccttttcaaggcaaatctaaacacgttgtaccactcatccctgggttaaaacaattcttttgcttctgattgtttataagctaaagatcaaagtccccatcctgacttcacatacaggtcttgtccttctgaccttccccaggctctctcatctcacttcccctttctctgtgagctccgtgacaccataatcttctcacagtacttaaactttgtcacactccttctaccacaggacctttgactgtgctattgctagacagagcaatggcatggtcaaaggtcctgtggtagaaggaatgtggggtggaagtgtggtagaaggaatgtggtagaaggagcgtgggatgggaggcccataggccaaatccagtgcactctgtctttattagaataaagctttattagaacacaaccatgcttatttgttcatgcatttcctatggttgcttttgtactacaatggtagagttgagtagttgccacagagaccacctagcccacaaagcctaaaatatttactctctggtctttgacagaaatgttttccaactcctcatctagatcactggctatacccatgcttttctcctaattgattcctttagacctccattcttacatttcttcctttcctgacccccttctcccttcaccagattggatttcttttgttaggtgctatgacagaattgtattccaccttttttctcagcaacaactgcggtttgcaaatgtgtttaagacttgacccctctactagatgggaagctgaagaaaggaggaccatgtttttgtttactactgtatcctcagcagagtgcctgacccctctgttagatggcaagctcgagagggaaggaccatttattttctgcttattactgtatcctcaacatgtggcacagcatgtggcacagaatgaatacctgaaactcttgttgacagatgggtagatgaatagttggataaacagacaagacttaggtatataaatcctatatactcagagaaaactaaaaggaatatttagaaagctcagtacaactgacatcacacactattgtcctgttttcagcgttcagaattgaataaaggtggataaagaaatcaagggatgatgctttgccagtcagatgctatctggatcttagcctctctcccactcctgccatcacccactgtagccaacactgaagggaattttacaaagccctttttatggttcctacaaaaccagaagctgctgctcaaaatatcctcaagaagtcaaccatttggatctgggaatctgatacaattagtccttcaatcataggaataggaagagaaatcagctggtgatcttcagaccacatacaaatataggcagagattcagataggctactatatggccctcccgatggaagaaccaagaaaaatagtaaaggaaagaagcatatataacaacagatgtgattcttgattggatggatgaccctacaggtagccatggggacaacagtattctgaggaggttctgggagatgatgggcacctgttacatgggtttaatctatgtggtcatggatacctggcttttccacaccacttgtcctggcagccaagatgtttctctagttattgaaactccgaagtaaaaactgtgaggtaaaaaggaagatatttggaccatgctggttttctaggtgagaggaagccacgatgagttgataggatatcaaattcttctaggtgagaagcagccaggatgagtttaataccagcaggaatgagctgggtgcagtgactcatgcctgtaatcccaacattttgggaggccaaggtgggtggatcacctgaggtcagaagttcgagaccactctagctaacatggcgaaaccccatctctggtaaaaatacaaaaaaaaaaaaattagccgggtgtggtggtgcatgcctgtaatcccacctactcaggaggctgaggcaggagaatcacttgaacccaggaggtggaggttacagtgaaccgagatcatgccactgcactccaacctgggcaacagagtgaaactctatcgagagagagagagagaaggagaagaaggaggagaagaagaagaagaagaagaggaagaagaagaagaagaagaagaagaagaagaataagaagaagaagaagaagaggaagaggaagaagaagaagaaggaggaggaggaggaggaaggggggaggaaggagggaagaaaggaaggagtggggaggggagggaagaaggaagggagggagggaaagcaaaggaaaggaaaggaaagaaataccagcaggaaatagaatccttaaggtacttcaaggtgatcaaagaaaacatcatagagaagttgaatcttaaacactgtgtggtcagaattagtcaatgcagaaaagaagaaataagtgacatggtgtaacacaccatatcacaacttaacagtgtaaaacaacaaccattgtatttggcttctaattctttgggccaggagtttggataggttacaacagggatagcttgtgtctgcttgaaaatggggagcctcagctgggatgacttgaatggctggagatgactgtgacagctcttgtaggacaacatgtctgggacctcagttcttccttaggtggcatctgtcagggatggaaggcccaaatgcctccctcatttgcatattcaacccctatgctaaaatgactgtaacatctagggtaggctggaatcactctctccctatacatctaccttaggcttcctagcaacaggacagactcatggtaattgtacttcttgcatgatagctgtcttcccccagagcaagtgtttgagaaagccaggagaaatgctagtcctcctaaaaactaggctcagaactagccagcttcacttctgctgtgtatcattattaaaagcagtcacatattagcctaaatttaagggagtagaggagcagactcaacccttctataggaaaaatggcatatgcatataggaagagaaggaatcaattgtggtcatcctggtaacaagctatgacattattctaaaataaaagaatacatatacaggggcatagaggtgggaaagtctacttggctaatatagtcaataataggaatattttcaaaacctccattttccacttggattagcgtgataattctgctattacaagcaagtagttttgtggtctctgcacattttacaaatctatagcttttgctctcttgtacaattccttgtgagtataaatgtattccctaacatccagagtccaaaagacatcagtaatgttaacttcttcctatatcctgaaagacagggtgaagggcaggggacggtgttagcgtctctgtccatggtgttggtcttccttgctgttaggttcccaggaagacccttccttatgttgcacttaaaattataagtggattggcttctctgtagtacttgaaatattagaaccataggattaagtggtaaaagatgaacctgaagaggtaagcaggaactggggtctcgaatactagggagtttgaaatgtattatgtttctgcaaggagctaacatagattttaagaagtagaaaggaaggattgagtcggttttagaaagatcatcttggtgatagtgaggtaaaagttttggagagtgggagtggataaagctttaagtaagtattgtttctgcctatatcagacttcaaggaaagtgacagcacaaaatgctggtgcacatggaaatctgattacacacacacacacacacacacacacacacacacacacacacccgcttgtaggattaacagtcactacaacccaacgggtatggccaactctctgtaatgaagcaatggtagagagaaggtgttctacggcattccattcttgaaaccatttttaagccgagtgtattgactagatctccctgcttgctccatattgtattgattagtcagtattttgagggtgtgatacctggaaatttttggacatgtttgactttgaaatgagtgttcttattcagttaatgtctcatgggaccagttgagtttttccaaggtgaaaccttttatcttcaggatctttgatctaggttagatgaaattcccactgatgtacagacatgacagaggctcagaacataggagtcattccaaactaacagtcacttctgtctcttctgcagtggagacccaaatggtcatccagtgaatcttcagccagctgtgttctagcaaatacacacacttgcaaatctggtccctgtcaccctctctgtaacccttcttattctatcccatcattctcctttcatattgatccatcagcagaagtataccaataactcactatctttgttatgctttatttatgaaatagccatttgcctagcgtgttcttcaattttaaaaaacaaactcacaatgccactgctcaaccaaaaatccgttattggcttcccattgccctccagatgaagtaaaaattaacctcgtggcctacaaggctcagaatgacatgacttctgtcagcatctttagtctcatctctggctactctctgtcttgctcaatatactccagtcatattgacctccttcctattctttgaaaacactaagcatttcccaaaatatggctttcacaattctgtttgctctttccagaacagtcttccactctatatttcactgtttagccactttttatccttcaggtctatgattaaatgtcttcttttgagggattccctaaattgtctatctaaacagtggccacttgttgtttttttttaattttactacattctagtccctcttagcatgtgtcagaaatttcttgtatgcaaatgtttattcatttaataattttttggctaatgtctgtcatcttcaccagacttttaaaccatgattgcatagacaacttctgtccgggcttctactatatccctggagactagtatggtgcttggcctatgaatacgattgagtggtatttgttgaatgaatcattatgctaattttaagtcaggatagatcacaatggttcactttcactattcagtattcagtcaactgatcttatgcattgctgggacaatgaggacctgcagacatagcgatgactagggttactcttagattttaatcccatagaggaaggttgagggaggaggacaagggaggggaccattgcactagtctgggagagatatatggtgcactttgcacctccatttcttagaaagtcctaatcctggtatctttgtcctagtcatcagttctaaaggccccatcaccaaatactggcttccttggactctctaccactcagtgtagccctggaaaacagagggaacactcttcagacccactttgtgtcccctactgcccctacccttgtgatctcccctctctcctccagagggctctaggcttctagccttttacacttccccagtcacagcttactcttctccaatttcatgcccttgtgagccttcccaatatctggcataatctgaaaagtcaatttactcttacgtattaagggatgtatcatattgtatttaaatgggaaagtacaagaaactaatatttattgagccctaactgtgtgccaaggactatgctagatgctgtgcatatgttatatcatttaatccttaaaacctatgagttgatgattattgttggtactaggcttctttcacacatgtggagattgaggttcagggagattaaataacttgctcaaggtcacatagctattagtagtagagctaggatttaaacttaatctttctcttgcatatgatcctactactataatgtactccctcccaaatagtgagaaatatgcggacacctctgaagccactaagtaagaggatggcatactgggacagtggtgtcttaaaatcagaggatataggctcttgtttactccactgatttctaagattgcactactctcttcagaggttagagtgtaacaagcttctgaacatgctgccactcatttattcaacaaggtttgttgagcacctactatgtgcctgacatattatgcacttttaatatacatcagtgaagaatacagaaattaaaaattccctgtctttctagagcttacattccattgatggtaggaagtggaaagagagacaggaaataagcaatggacagcaaaagataagtacattatatgatatgacataataacaagtgagggtgcactgaaacaatagaacatgctgaatgggatcaggagtcataagtggaggaggattgcagttttatagaagatgacatctgactaaagactttaaaaaggtaacagatgtgagccatgtcaggaaagagtgtctctattagaggctcccaaggcaagcatgtgcctgatatgtggaagctagaaccctgttccagctgtaaaggtcagtcaaaaccagtggaacccataagaaatatggacttctcctctaaatttagatcctttcagaaggtaccattgtaaattaaatgggttgaaaccatggtgcttccaaaaaatagtgaagacccttgtgcctatgagagctgagtctcaccactagcctagccttctggggtaaggagaaaactctgtaatctttgacttccttgtttatgacaaaacacgtctatctgcaggaatcttcccggagccaccgcatccaggatctgtccttggtgctgaccctgatcttctttagctcaagatgatctagcattgatttctgcatcttcttgcccattgctgggttctgctattactacagctggctatacttggctattccatgcctttctttaggctagtcacccatactatcatcatggtgattgctccagccccccagattccggtacacctaccccattcagacttagtcccttggccctgcttggcaaagagcccagtgtaatactgttaaggatgttagctggcacagtcacttctgtcattgttttctgaaagcatcattgctttttcaactgaccctaaatgtggtgagggtttagtcaccattccaaatcatttatttagcatgaaaatttattagttaggccattgtttagcaaattcatcacattatattttttacttagcattatcacttaattagcgttttattactggaattggctgtcaattatgtggctaattcattgtcttagggaatggattttttatctgcgtaaagcaattgaaagtacattgttaactctttaacgattaaagattgttgtcaatggcaattcatgtgataaggaaaattaaaccatttactttccttgaaaaatcagatcttggaaaactctttggaaaagtgtaaagagggtactttagaagctttcatgaattaaaaaacttttattaagtgaatgccttggaatacttggcaaagctaagcaaagtcagctggaagattttgactggactccttggaatgaattattataatatactctcatatgtgtatatttaaatgttctttcatcgacattacctcttttggttctcacaaaaacattgcagaatgatattaggatttgtggttggcaaactttaagatggccccaatgatccctgcctcctatgccacattcttatataacgcccttcctcattgcagccaagatctagtgactggcttccaatgaataggatatgataaagtgatgagatgtccctttcaagatttgtctttaagaagactgtggcttttatcttgggtgctctctctcactcccacttgtctgttccttgggaagctagctactatattgtaagttgacctattggcaagaaatcgagggagatgcccagccaacagccagcaaggaactgagtcccatactgcagtagcccatgaaaaaatgaatctgtcagtatcatgtcagtgattatgaaatcagttaacttgaattctctcccagctgagtcttcagatgagatcattaccacagcggtcagcttgagtgcaacctcacaaaagaccttgagccagagatacacatctaggctgcaaccagatttctatctgcagaaactgagatcgtatatgtttgttattttaagctgctgtggttgggggtagtttgtcaagtagcagtggataactaatacatggcttaacatgtgagatgttaattaatttgcccaaagcctttgactaataagtagtagagccaggatttaaccctggttcttctgatgcatttcaatagacaagaagataggaattacagtccagacctctcattgcagctgccagggatcctcaaagctttgacatcccataagggcaactattcagggactgtttccctgtaacattgactcccttatgacttgcacacctttattactatgagaatcactaggattcttcagaggctggcaagcaggcttgaaaaacagatcttctggctgggcacggtggctctcgcttgtaatcccagcactttgggaggccgaggtgggtggatcacaaggtcaggagttcgagaacagcctggccaacacagtgaaatcttatctctactaaaaatacaaaaattagccgggtgtggtggcaggtgcctgttatcccagctacttgggaggctgaggcaggagagtcgcttgaacccaggtggcagaggttgcactgagccaagatcatgccactgcactctagcctgggcgaaagagctagactccatgaaagaaagaaaagaaaagaaggaaggaaagaaggaaggagagagaaagagagagagaaaggaaagaaagaaaaaagagagagaggaagggaaggggaggggagggaagggagaagagaaggagggagacagacagacagaaagatctttaccatgttcccaataaggaattgggtcaaacttaccattcttcttccctaggtgctatcctgcccccccataaaatggttataacagtagttcccaaaacatgactggccccaaactaaagccactaaatccttatgtctagaatatggagcaaaggaatctatatttagtatgttctttgaatgactcttgtacggtactagcatttggaatctactatataaaacaaagtagtttggcatttcagtgatcagcctctataattcagcacctgaggatcagccaggctgaaccttgatggggacacactgctttattcattcttatgagagtgttaggtatctgttctttccagggttaaggccatcagatttaattagttgcattttttggttggttttgaacaatactaagctgtactacttcattcattcagtaagagcagaaagaataatgtttgcttttttaagagaaattccaggacctttaaagaacacattgtatcttttaactggaagctcccttagagaccacctaatccctcactactcaaggtgtggtccatggaccagcatcatcagcatcacctgagagcttgttacaaatgcaggctctcaggccacacttcagcccactgtattagaatctgcctatagaagatctctagatatgtacattacaccttgagaagcattggtctaattcagctgcctggttttaaaattaaggtccacaaaggtgaaggtaattgtgcaagataatttagtggtaacaccaggatgaaaactcaggtcttgtaactcccaaactgtgttctttccattgtcttaatgtcccgttgtctttgtagttcataatatccacaaactcagcctaaatatccagggcatagtttgaaatggagaaaggaagcttttatccacccacaacaatggcaaactctttcaaacatctgttgcacatttaaatttcatctttcagacaagtttagttatttcattttctctttcttgcacatcaacaaaagacaaagtcacctgtcaggctgaagattgtaaaaacctgtcaaaattgagtttttctagtttagctaagtattactctgcaactattttgcattccttagtcttattataatttttatgaatgagagatagaaaataggagcagtctgtattttcagtgtgaggcattacttagtcttttccttctatcacacatcttcccataagtgtgcaggttatggagtttggtgatatatacataatacaaaattctgggccagttgttttcagtgcacatacaaccctggagccaatgagaaactccaaatcatgtccagtcccctggagccacagtgaagctgaacattttcactctgagagaagagcttcggatctgagtgtagttaaaatcaccagaagcccatcaggagaagatatgcattttgagtaaatgtggcttatcaacctccccacactcaccaaggcaaatggaactgaggcaggaaatagagatcatgatatcctcaccaaaagaattagaagacatgacagatgaaccttgaagataaacaaacattgtatttatcaacaaggtggagggtggatttcagagagcaaggtgtacctaacaaatgagtgtttccagagtaggcactagattctggagatacacgagtaaacaacacagatatgatacctgtcttcatggagcttacagtccggtgaaggataagatactaatctcactattattcaataactatagtaattcatgaagacgatgtatgttcaggaatatacatatattgtaattcatgaaaatgatactgttaggatataacatgggaccctcagatggggatggaggcagacagagatgtcttccttgatatcttcattcagaaaagttaaaatacttttagtgaccagtcatcccctagattctactattaacattttactatatttattttattacctatcttcccatctatccatccttcaatccatcttaatttttatgcatatcaaaggaaattttagacatcactacacttccctttcctcccaatatttaactgtacacatcattaatgccgactcaagagtctggttttttcctttgagataaaatttacttgcaaaaaaacacagaaatcttaggttttccattttatgagttcaacaattgcatacactttgcaacccagccccctagtaatatacagacttgccaggaagatccctcatgcccattcccagccatcccctgcccctactcaacccaattggtaaccaccattcattcataccacagatgggtttgtttattctagaggaggaattgacttgagctgagtgctgaaggatgaataggagtccacgtggccttggaagtttgggggaaaagttataaacactccaggagaatagcacgtcctgtacagattctcaggtgggcgagaattcagtgaggagacagtgtggctgcagcctagaggggaaaggacagagagacacaagatgaggcaaatgagattggtgagagctagaccaatcatagccttgaagccatattaaatatcttaaatctggaacatagccaaaggacagtgggcatccaataaaaagtttgagcagggaggtgacatgctcagctttggcctttgaaaaagttctcatgccttattttggagaaaagaacatggagaaggaagaggggattcaaggagttgtaaggatgttgtttcagccactatggatagggaaagagaggggcagcagatttgaggatcctggccatggagagaaatgactatctcttcttctgttgtattaacctctgatgtgttgaacttctaacaattataacctctgatgtgttgagcttctaacaattataaatcagtgcttgattttctctttctatctccagttttcagagatactagccataaaggctttgcagaaactggttcagagagattgagtaacttgcccaaaatcacacaggcagtaggtgatggtgtcagggttctcactcagccctattcatgtccaaagtctgtacgtgttagaccactaccctgtcttcagagagtattgtgtgagcctctcagtctttcctattggacttgccgttttcctcaatatatcagattcttcaaacactctagaattttcaaggcagaagactgtccgagttgctggcagtccctgtcaacacagggccccactttgaggataagttcacctgcccaagttttcctttaagtgatggtttgagaataggggcaggtgagtccacatggatctatcaataccgggttttatttatgctggtagtggctctgtgaaacacagaactgacatgcagagtcgctttccatttcttgtgcttgctgcctcaatcaatccctttatctataactcagatccttcctcatttaatcccagtctttccttccatataaactcctctcaaatgccacacccttatcactcccttcatgcttgcaagaatattaaaactgtgtgatttacctttctttattatttatgctttgagtaacttactgaccaagacatgttcttctaagttcttttgcatatgctatttatcttaacaagccatagtcacatgcagaacttcttactgaaagcatgaagtaactttccaataatattaatctttctaacactaagccaccttacagtttcatctactttaatatacttcattctcttctgaaaaataatacactctctgggaatccattctttgccaaccaatatttgtactctactttatcatcagtttataaaattctttaggcgtatatttcaatgtctatttatgggttattcttctaccggtcaaagttcagcattttttaaggccattattttcaacaacaagtgtctctgaaagtataaatggatggtgaatatgcaagaattaaataatcaacctacatgttaccaaaaagggcttatatttccagtgagttaaaagacttaaaaagtccataattatatcccttcttctttgtggtgcaacaaaatacttccaggattccatgcacgcccctcagctttattccctcacttcctagtttgatcactaagtggttaaggccagccacagagaatccctatcactactaaacatctgttgctctggcaaactcaacgacctttcattttttttccaaatgtattgtttatacaacctatgctgtggaacactggtatcagcatttttgctgcctctttcctcactgattttgatagaattttgacaaaaagaaaaaaattattttgaaagttttttaaaaaatagtgaaacccttttttgaacaaaattatacctagatgtttattttctaaaacagataaaaagccatttatatctggttggagaagaggtaagggaaaactcacatgcttgccaggatacacacactccccacacacatgacatgcacaaaaccctttattgtggcccagttcactccagacacatagaagaatctctgaacagaggtctcctttcctaactctgcctcagctcttagggaactaagtccatagactgatgctttgcttattgcttcctctctagaccagatgggtgaaactttccacttgatttactcaaaatgaaaataataaccgctagtcactggaacaagtcaagattgatggcccttgtagatcacaagagcaaggccgtcaaaggaatgacaccctctaaaattgaacagtgcacagcatgtatgaccagccacatattgtggtcctgtggaagcctggattaaaggagcatcaggaaagatgggatcccagtttgtcgatccctagcggagtttggcatttcactgagagacaattcttttcattattgctgcagtctcccagaatctagtaaccaggtcttagtgtagaaagaagaaactcagcgctagtgttccattgcatgagaggtccttgtgatgtaaccatttctgcatcttgactgtgatggtggtcacacaggtctacacatgggataaaattgcataaattaaacatacacacaagcgcatgtaaaactaatgaaatctgaataagatcagtaacatatatgtcaattttctggttataatattgtactatagttacacaagtgttaacattggggaaaactgggtgaagggtatttaagacccgtttatgttatttcttacgattgcatgtgaatctgtaatgatctcaaaatatgacttcttttttaaaaagctagcacccaggtgatgggctggtgtttaccagctgaccctgaccacgtccatcagagtcttgagatgtgtctcagggcttctctggtcattaatcattctccagtctaagcctgggctaaaaatgttctgtcagtctctaacaactgtgaagtggcttatttgtgtcttttttccttaatcattttttggcagaggtttgtctaatttgttggtgttttcaaaggaaagagccagcttttgctgttttttttcagctcctctgctgtatctttaacttgtgttatgttccatgtctgttcttatatacatatttactttctttctattttcaatgactatgtttttttatctcaagaagttgaatgtatatttttcaaacccacctatcctttttctgtcatgtgtgcattattgcaatggttcatattccttcttttttctctttaatcaatctaaatgtatttacttaatagtctctttgattgttttattattttcaattcttgagaggtgtatttttctgtgtatgatgacttctgactctctcctatggggataagattccttacaaggctcttgtcattctttataatttattttttactatgagttcgtctttagtggaggcagttttgttctgtgggaattaatgtgccttggattatgaaaatacctctacaggatgatttctcatttgcttgtcaggacagtgtagttttcagtggtattacacagtttttttaatgttgatttctatgttggcaggtgcttctatcaaacaagtaacaaaatttggatgccagatgcacttgtactagaagtcagggttttcttttgttttgtttttttatctctatttgaatcctgttcattcttcttgttatgctagtagttgatgccttaaacacacacacgcacacatgcacacctctacagtaccctgtacagtacatacacattcgcttaaaattgtgttcttcaattaagagtgtcaggattgaaatagtacacattgaatatccattatgaaaggtgaagaagataatatacttttattcctagtgatgtatcagtcacccacttcctggtttttgttaatacaattggaaattttagccaagaatttttatattagatttttaaatctgatttctctttaagcattacctcttatagttcattctgttttgattcacatttattgtgatttttacactcatatctgtgtttaccaaatcaactttttttataacaagacttcttccattcttgtggatgtttttttctctatttctggactcacatccttgactagctttatcagctacccaaccctctggaaaagaatcagagccaacataacttcttattctttatgtgtcagggaatgcctttctgtagcttcgcaaatgaaaaactatttactgtataattttttagccacatcatttttacttgaaaaattttgtttcattgttttctggaatttaaatttgggcaagaaaatgtatgagtaacgtagtttctgattttttatacatagccattttccagcctagatgtttatctgagtatttctacatcaataatatttaaacaattgtatcagaatataggctctatttttaagttgtaggtggagaactctttacacgtgaagatttaagtttttattttgccaatgagttgttttaatattgtgtcctgataagaaaggacacataatgtgcttctgttccatttattctgttcttctgtaacagcaattatgtcttttatatgtttgttttcttttctctaaaaatgtctttttgttcccttcacacatgaacacacatgagcagatgatatatacaaaggaaatatacattgtattgttctgctttccttgcgttttaatttccaagtttttcaaattaattctccacaagcctgttgcttattctcattacagattccagtgcccattttaattctggtattgcattttggtttctttacaattgtttcttacctcacccagtaaatattttttctagctacttcttaacttgatctattttgggaaaagtctgttgtcttagtcttattatttcacctttaatttcctttattcttctatcttttctcgcatttcgttttcaataaacttcaaggaacctaaaatgcacttctactttctgttgtttagattaagataccagtaacagaaaaaaaatgaataaaaatggcttaagcagcaagttaatgtattatcttctagaacaggaagtcaagtgttagagttggttgaatgagatgcccatgaatgtcattgaggacccacattctttcaagctctcctcttcatcatcttatcttggcatgagggcaacctcagcccagctcccctcatggatgcaagattgtttcagcagttccaggcatcacacacagacatggtactgtctggtggcagagacgggccactggattgtccttcttagagataagagaacctttcctagaagccttctaatggaacttccctcccatatcatataaaagatttttatttaacttgcaaaaggtatcggaacaccttgatggcgtagggacatcagaatttgtcccttgttttgggagtagggtcattccctgcccccgcccccaccaagtcatacggtgaacttagccagaaaataacaagacaggggatggctcttgggtcaacagtcaatactgactgttgtgtgtgtgtgtgtgtgtgtgtgtgtgtgtgtgtgtgtgtgtgtgtgtttgaaaattgtacttttcacggtatccaggctatcactttccttactgttaacatggtggattttcttctaagacctcatattatcttgtttctgtttatttaactttaaaggaagagaagtctctccagacctgttgcttgccagtaaatagaggaggtagatcctcatcgttgcctcactgtccaactagttattgttggaatccttttattccataccatcctggcatgtgtgatgctgctataattcatcaatattcctcccaaattctggcagtggtttaagcaagaggagcaatggatgtttatagcccccatccctacatagagtgtctaacaccatccttccatctggtgtgagtgctgtgaaagaaggaattcatactctcccccacaagcaggaggattgatctctttatcagaaacagtaaatgaatcctagaagcattttcccatgactgttcccatcacaattgcttcctaacactgaatctgcgtctcggaaacaaagataccatcttttgtctttaccatgtcaaagaccccagtgatggaggtttaggaggagaaagagcttggaaatgccccaaccctgctatatggttgatacagtctttgattctctgagctcaggaattaaaatgagaaaattggaagcatttcttttctgttcttcaggccattgggtttgctttatcccaagtaacaaagtctatcaaagtcaattgtatcatgtttgtttcagctccatagaaaatggcacagtggagtggcattctattactattagttctacaagttcaaccctactatgtgtttggtcagacataagaaagatgggaaaaggtaaatccatctgttgttacattgagtaagaggatgtgaatctactgttcctcaggggtcacaaatctcatacacctatgctagtgcaagtctagaattcagaaacacagaacagagcattcttacaacatgactcctaagcacaagccaactgcttcatcttatgcttcaacaaggaaatgtaatcacttccagcgttggaggggaaactacctgtggttgaatcaattgagagattatgttgaatcaattgagagagggattttcgagaaatttttagcagttgaaatatatatcttcctgcacatgggatgtgtgctgctgcaataataaacaagttttcttcccagattctggcaataggttagtggatagacttagatttcagagctgttacaagtttattatcttgagccttttctagtattttgtgagggagaagaggggaggcactgactgccagccaggttccaccttgagatttcttccagtggaatcacatttaacccttgcaacaaccttctcagaagaagatgatgatgatcaatcatgatcattgtcatcaccatcagcaattacaaataaagaccttaggctcaaagtatggttacccttgaacaacatgggtttgaactgcacagctctacttaatatatgaattttcttctgactctgtcactcctgagacagcaagaccaacctttcttcttcctcctcctcctcctcctcctcctcagtctactcaatgtgtagacaatgaggatgaagaactgtatgatgatccacttccacttaataaatagtaaatatattttctcttccttatgattttctcaataacattttcttttctctagcttactttactgtaggaatacaatatataacacatataacatacaacatgtgtgttaatcagctgtttatgttatcaataaggcttctgctcaacagtaggctattagtagttaagttttgagggcgtcataagttatacatggattttcaactccacagagggttggttcccctaacctccatgttattcaagggtcagctgtaacttatttgaggtcctatagctagaaatctgtgaagatcacatttgaatccaatgttttatcttcagagtgagtctgtgctttgactctgatacctgctgttgccacagtccccacagtgttggttccagttgcatccccactctgtgcaggtgacccagcctcctcttcacctcaaaacttctctcctcttccagactctctcctctcaatgagcagtcgctagctacttacacatcactcttcatactctcctgccctaaagagcacatggagctaggatgaatagtgatagaagaaatacattgatactggtaaggaactacaggaatttgattagctagttaagaaattttgtcttgactccctgaagacttttgctaagaaaaatgacttgatcaaagctctgtaaagggaactgtgaaagaaggaagggccatcaggaaactgatggagtagtcctgtcatgaagacctgaatgagggcaatagcagcaggaatggagtaaaatagatggctttggggtgtgtcataaaggaaagcagagaggagacaaggaaaggcgaaagaagccctaaatgactccctagatgccatctctagtgtgtggattctcatatgtccaatatgacattatgcacaaattcatcagaacaaatactggtttttactgcttcctggataccagacactgtactgagcactcagcatgcactatctctttgaatccttacaacatgtgttttctctgtattatagataaagaaactgagatgcagaaagatttgtcacttggccaaggaatgatccaaaccccattctatctgattctgggacccagactcaacatttctcagggtgcagattgagttcccctcatgcaacatgaacagaccccccttttttttttttctaagatggagtcttgctctgtcacccctggctggagtgcaatggcaccatcttggctcactgcaacttccacctccctggttcaagtaattcccctgcctcagcctcccaagtagctgggattacaggtgcacagcaccacacctggctaatttttttgtacttttagtagagatggggtttcaccatgttggctagactgatctcgaaactcctgacctagacaatccgcccacctaggcctcccaaattgctgggattacaggcatgaaccaccgcacctggccccgacttcttctcaaatagttatgtaaacattttagtgagcactaaaacaaaattagcacatcacattcatgattttatgttgcactatcattcataatgaggcaaagttaaaaaaaatagttgagagtttatctgaagaaaagttttgaagatgtaattgtgtagatctgcattgttcaatacagtagccactggccacctgtggctatttaaattgaaataaatcaaaattaaattaaacattcatttcctcagcaccagtaggcacatttcaaagtgctcaatagccacagatggccagtgactaccatattgaacagtgcaaatatagaacattggtgtcaatgtgtaaggttcttttggatagtgctgggtgagagctgttttacactggatcagtgtctttttatttagcatttactccagctctaaattacctctctttagaacttgatctggctctggataagtctgtgtgcacctgcattgtcccatacattagcctaccatttaccagtgtctgttgaatcctggaaatatggccagtctgaattgaaatgtgctgtaagtgtaaaatacacgttggatttcaaagcttttgtgtgaataaagaatgtaaaaatatagcattaataatttttgtgattatatgttgaaatattatttcagacatatggggttaggtaaaatgtattattgaaattactttcatgtgttctttttcgccttatttaatgttgccacaagaccatcttaaattacatacatggcttgcaatatatttccactggccagtgctattctagacctctttgccccactgtgtgactctagaactctctttctttccctatctctttctgtatatctgcactgcccaatatagtagacataagccacctgtaaatatttctatttgaattaattaaaattaaacaaaatttaaaattcagctcctctgtctcatcagccacatttcagacgctcagtagccacatgtgattagtggccaccaaattgcagagcatagatgtagaacacttccattgttgtggaaagttctattggacagctgtcacatagatggtacacaactatggcaagagacacagaggtggatcatgaatgcctaatgcttggagaatgtttccagattgccaaaccccatggcacatccttcttccatctcttaggggcctgtctcttcctatcttaggcttattcacgcacaccttatattttcttctcccctccttcaagggctgtggcctgcttatttctccctgaacatacctccctgctgtatgaacacaatatctaacgtgcattgtacagtataggtactcattaaatatttcttaaccagttggagtggcaattcccagtaagtgatggaaatatgtgactaaaggtagagggagatctatatggctggtagcagtggggcaggggataagggtgggcagcagcggtgatgaatctaggatcccaaggaagaggaggagagagcaggaagacagcaaagaggaaatcagtgagacagtaacccaaaatctcatacacagcaccaaaatccttctgcccatcccacaagctcctcgcgggcagtaacaagagttactgcaggggaattcacagggttaggtaacagctatataaaaagtgtgaaagaaatccaaaatattattgcacgataaataaacataccaaacccataaatcagaagaaggcatgagaattaaggggctggtgaggagaaaaaatgaaaaatcctctgtccctgggccagctggtgtgagttacattttatgagcagcgtgtgaattccagtgcccttgttgaattagcagcagaatcgcacattagttttaaggctccctcttgaacaggaacatcataacgtcttttaattgggcctgataaaaacgtagcattacttgtaggttcctgagagaagtgagttgtgaaattgggttttcattaaacctaacgatggaaaattaagtatagtgcgtctggtgaaatggagtgtgataaaagacatcacttctgcattatcagaggttaataagggaataggtgaggtaagatactttggaaaggggagtctaacccgttggattaataaaccttgaaaatcccttggttctgagtcttcatagcatcattagcactggcattgacattattgcaaatgttacagcaatacaagttgttaaatttcaatgcatttattttccattccagtgttggttttgctgacaccaagtttacagtctgtctagcaatgtgtttagggaaaatatccatattgacagctatttggttttggaaacatttgacatttctcacacacataaaaagccaagttcccattcctaggaagcctgtctttcccaggcagctggtctcccatgcagcccatgccccaagttcctctgggagactgtgggtctctgaagacaactgtccccatgtttgatggtagctttggtgggaaatactcacaggcctcctagcattgactcagctcatcctttcatagaaatcatagagtatggcatgactccaagctttaggtatgcagcatccatacctctgtggctcttgccatagctttgtaccatctctagatgaatcaaacacaagtgctcccttcctctccatttccaatcacaccatcacaggagtgatattcgctggaaggatgccttcgatgagagctattcatgacagctgggacacctacaagaaacagtgtgagtctttaaagaaggagattcctcctaaaacccttcagcaggttcacactggcttcaagggtcttgcacattcacagtctctggatctgccttgcaccatctgttacagtgttgccctcccctgacatttctacccacagcttttactccttatcaacctccttgttcttaactacatgtgccttcatctctcaggctctgtcctttttcttcagttgattcttctcgtctatttccttgctagacagtcaagccttgagggtggaatcagtatttctgtctgcattgccactgcctaccatagtccttggcacagagtgggttctcagtaagtcgaactcatgaaaccaaggggttgatggagaaagggaacacccccatgtttgccaagtggtacatttaagcaatgccagtgaacatgtactagctattacctaaaatcccgggagaaaaagtaagcagtatttctctgtgcagtcaggaaggttttgctaacgacttgcctaggcccttctttcttgtgcataaatctaaatcttagaaatctttctgtaagcagtccaggggttatttggctggtccccaaaggacagtctctcctttggagatgtttacctaccaccctgaattaggaagttttagagaccacactctgcctacgatgaccccacctactaattaggtacgaccccatcagtgtctcaaagtcagaccagtcagattagtagcctctcctcccttggtaggtggaggcaggcagaaggctgcaaagtgaaaaatttatcccctactccaaccacagatataagtgaaagcattagggtgaccaaccattcctgtgtgcccatgactgagaggtttcccaacagctgtactttcaatgttaaaactggaaaattgtcagtcaaactgggacaagttggtcacctagaaagcaggaaggtcaggtgttcccttccattatctttccttgccaggaacaggcttgccgatgctgctgccgagaagtagagtgtgcattcacacacaggatccatgtctgatggagtattccaacatgacaggcaaataagctgaagggcacatggattttgaaaagacaagttgcagaaaattgggaatatatgctaaacctcccagggaatgagtatggcataggccgagtgggtacctgcataggtgttttgcagggtctgaaaacatctgggggagacacattaactgctgcagctggcagttctcatctcttgcatgccacaaacaagatggtctggggcatagactgtccatgtctttggaaggaggttgggaagaccaagcctagatggttctgggaaaggtaaactggccctgagagatcaagaatgtatgcctggcagggaggtggtaagcaagaaattggttctagtcgtccaaggggaacagaagaattcaaacccaatctgaccaggcatcagttttcagggtgaccaaactgacagaaggcagttaaagcaactcattggatgaaaaggtttttatcaagagagaatatagatcctacatcagggagagattttatgaaggcgatgagacatagcatccaggcccggggaaagtagctagcagcactgaaggaagaggcccaggcttccctatctgcaaagtgggttcagtgatgccactggattaatagtattaagtgatggggaaactatacaatagcaagaaggtggtcactgtggcagagctcataactagagagagcagctgggagggtcagggtccctgctagcttctggcagtccaagactagccccaattcttcccagggtaaaactcaaaggaaaaaaaaatagtagagaagccaggtcacagccatgcaggcaaatagaccagaattatacatgtgactccaatcttcgagtacctgaggccacctgaggctctcctcccctgcagacaggcatcaggcactatttccagcctctctgcttccgaaacaggagggggctcccaataaatagcctgcctagcttcttagtggttctgcccaacaaagtctaaacgaaggactgagacagacggggatgatgaacaacctggaactttatcagtctgtgcccttgaaatgtgttgtggtcattggtttgcttgtgggtttgatacttagatctaccaacacagccaggccagggaaggagtgtatctccaatccttttgcagtttccctatcagttgagtcccaagttggttccctctgccctcctcaggccaagctgggggagacagggaggacaaagggcaaagcttctataggtgatgatctgttctgcctccttcttttcgaagcagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggtaagagaccagcctgtggggaaacttcctgatagtttcagaggcttatttgggcactaaagccttgctacaaaaagtatggctccctggccagcagcctcagtatcacctgggagcgtgtaggaaatgcaacatctcaggccccatccctccctactgaatcagaacctgcattttaaccagaaactaggtgatttgtatacacattaaatttgagaagcaccatgctaaataattctaagacatcctttttcactcttgtttctctccccttcccctttcattatccaaagtttcattacctccaacgtttctgcactttggagtctcacctccattcactatgccagaatggctcaagctcccatcccacatgctgtagaaaagccagcacatctcccctgccaatgatttccagcatgcatgcttgcccttggtcacctcttgtctcatactcaagcttctgtggtattctggtccccgctcccatcccccgaaggcaatgcttcatctccagtgaccacagttccctctttctgcaccatctcttcaccctgcactgggcatccctttcccatctccccaaagcatccctaacacaaaggatttgcaggtagtggttgttaccgaggtttggggaataatagagaaggactgcagtaaaggacaggcagcagctcaatacaacgttgttcttcttataagttccttaaccatctacattgctggtaaggccttctaaggttctggtctcctgacaggtctctatctaatttctcctcaaagtcttctttactgtcttcaaaacttcctccacccccacccctcagcatccagacaaagggcaccacgttcctcttttattttgcagaacaatttagctttctttatctcactctttttgtttcaaatcctgcccattaggcctcacgttttacaaacaaaaagcaaaataaaataaaaggaaaatgcattaagacgtttttctgaaccaaagagcagctcactctccaagaataattctgcaactctcctggttgcagttagactccagctgcagccagctttgaaaacaagaatttctttcttcacttttcctttcctgtctctcccttccctccttctttcctaaaatatcttttgagtatcttctgtgtaccatggtctgagttatatgtatttgtggtttttttgttgtttgttcttttttttttcttcacatgcagcgtgtgccccagctatgcttgattcagttttgctgtgtgcagtagaaaactcattggctcagactccacacatttggaattcttaatattgcagactaagtttatccctcagactatattctgagaaagagcttacaaagcaatatttctgaagtcgtatgaggtcatgaaattgtgctaaactgggggtgcagacagctggattccaatgtagtaagctgtttgattttagaattttgctatctgagttttaaaattctttattagtcgaatgaagaatttggataaggtgatctctcaggacctatctggtcctaaaactttatgagagtgtaaaacatggtgacaaggggcatgtttgacatatttataagaacaaaaatgtttatgtcaatggatgtaagtaattacaagcttgggagagctagcacttaatttcaaaaacggtctaagtaaaatagcacttttcatattctcatctacaaatcttgaaaggatattcgaattagagttgaagaagatgatctcatcactacccatccctggatctcatttcctagggggttgaatggtcccagtctctgggacatagggtgcatgtgagcatgctttctgtgtgtgtatgcagacctgcttgttgaacaaatgtcaggaagattatgttatttggtaccctaaaacttaaagtataataataattaaaaaaagaaaatattttcaagccatatatccaagaaaaaaaaaacaagattctatagacagcatggccttcagaggatgggttatattttaataattagcaagaaagtgaggaaggcaacataggattgggaaaacagcctccaggtggcatatctcccaaaagaaactggaagtatgggaggtggataataaatagctgtttgggtgaaaaaaaaaaaagaaagaaaggaaatggtatattcaacattagtcataacaatttgattaaaaatttcaaatatcattaagggagatatgtggcttaccaaaaaaaaaaaaagggacaagtagccaaatgctgagaaacacatatgtaagaacttgcaatctgaaatttgaagacagaattacaagtgtatttgactactttcatgcatttcgttctagattaatatttcttttaaagcattcatccctgtgtggtgagttgcttttcaaactttcttcgttgtacccttttgtattttccaaactttctagcatggaaatgaacagcttttataatgagaaaacaaacaatacatgttatttcatcatttgaatctcaaccagaaatctaactaggctagccttggcctcaattagtccaaattatattaatcagcaagctgtaaagcttagcttctagttaacattattttctgattaactgagggttaattggaaaatattgcctgataaaagtcatttcacaatgtgctagcccgcaatgtccagcccagaatacagctggattgctttgatcatcaaggctcctgtgatatctcggtaatcctcctgagcataggagtcacagatctgctaggagaatcattgtcctattgcagataaaagactcctgagcctccagtgctactctcataccaacctgctctgtgctgtttgttgcctgtcacttctctgctctgttcagtgttttcatacacatgagtgggtttgacaagttgacatctaagggacatctcagccatagcaagctgcatcagaagacaaaattcaattcagttgaataatcacttaaaatttgttcagtaaatatgtactatttactattcccagggacaattctaggtatttaggatacaacagtgaatgaaacaaagattcttgcccttctgaagcttgtattctagaaagggaaataggaaataaacataagcttaaaaaaataagcaaattatataatgtagtgtgttagacagtgagaaatactgtttgctatgttacaaaccactccaaattttaacaacatgaaacaaccaatctcttgcattcattgattctgtggaatctgtgcagggtacaacagggacaacctgtttcttctacacagtgttcagagccttggctaggaagtctccaaggctgggggctggaatcatctgaacatgtcttcactcacatgtctagtgactgatgcaggctttcagctgggattgtccactggaagacctacacatggcctcttcagtggcctgggcttcttcacagtgtagtagccttgggataggtggacgatttccatggtggctcagaactccataggtgagctccccagataacaaggtgaaaagtgcatcaccgttgtggcccaaacttgggtatcacactgcattattcctaccatgtactattggttgtaagcaggtaaaaactccccactttctaggagaggggaatttgactctatcccttgatgaggaggaggggcagttgccagattctagaggagcatgcagagcaagaaatattggggggggaagaaaatcccagcactttgaaaggctgaggtgggtggattgcctgaggtcaggagttcaagaccagcctggccgacatggtgaaaccccttctctactacaaatacaaaaattagccaggcgtgatggtgggtgcctgtaaccctaggtactctggaggctgaggcaggagaatcacttgaacccaggaggcacaggttgcagtgagctgagatcgtgccagtatactccagcctgtgggacagagtgagactccatctccaaaaaaaaaaaaagaaaaagaaaatctttggataataatacagtctgccacaagtaccatggaaaaagaaagaatagagcaaggaagggagatttgttccagggacatgaagtagaggaggttccaatagtaaaaaggataaaaggatagtccttaattagatgacgaaacttggaatatagacatggtggaagatatctggaggaagagagttccagatccagagagtaatatatctggcatgtacaagcagttgcaaagaggccagggtggcagaggaagagtgagcaagggataagagtaataggagattcgactggagaaataaagagggacctgaccatgctatgcattacaagccgttataaggactttggcttttactctgactaaaatggaaagccacctcagagctttgagaagacaagtgctaatgatctgaccttacttccttctagctactgtgttgagaatggaacttaggaaggcaagggtgaaagcaagttaagaggacattgcagtaacccaggtgacagacaacgatgactcagggcatggcagaggaggtggtgagatgtggttggattctgaatatatttaaaagatggagccaacagcatttcctaacacatggtgtatgttacaaaaggaattaagggtaactccaaggctgttgtttgtgccactggtaggatggagctgcctctaatggaaatggggatgctcaagtaaagcagagctggaacaatcagtagtttcatgttaaattgagtttgcaatgtccattagacatattagtgtctccatgtggtggcaagaaggtagttggatctatgaagttggaatttgataaagaagcctgggctggagagaaagctttgggagttattggcctatagatgattaaagccacaagactgggtgaggtcaccaagcaagtgagtatagacagagacaaggacctaggaccaggcctttcagaatttcaactttaagatatgggagcattttccagggtacagacactgtactaggctctgggaactaaatagagcccttgcctgctagggaatgtagagcctattctgagagccaaaaaatgccaccatagaggtatatccagagctatgagaatccttgggggtgggatgcattaacccagcctaaaggtaaatagccagtggctttctggaagacatgaagcctcaaccgaagcttgagaagtaggaagaaccaaattaaagaagggaagggcgttccaggcagagcggctagcataagctatggcacaggggtgggcacagcaggttgagtgaggggaaccagaaacggtttgggaggaagcatggagggagatggggctgaaactgtcaacaggggccaggatgaagcaaaagatgagtgtttgttacactaatgactttggattgtaatcaagaagccactggagccatcgaagagagcaggactttctaaagtagatttgcattttagatcttgtagagatcagagcagggacaacagaggcaggtaggcggctgggacagtaattcaaggaaaatatggggctgcccaaaccaggagactgggcccagagcccagacaagcctacgcactttttctgcatgtagagccataaaatcagcttgttctcgttggcatgaaaacttgagtctctcaatatatattttaagttcaattatttgaaataatgtatgaactatcttgaattgaagagtcaaaatgcctggaatcaagtcctataacattcattaagtattcaggtgaccttaggcaggtcactctcctctgggcctccatttccacatttatgcagtgggagcaaaggggtttgtcaaagtgatccaaataacccttctgtcactgatattctgggagtctaaataagaaccaattggccgagccagctgggcctccctcccactgatggtcgcatgggacctcactatctggggctgccgcttccatggttatgtctcaagttctaaaaaccacaattggccaagggccttgggctcctaggagctcaaggaggcccaagacaaattaacttcacctgccagatagatctgagcctcagtcagaggccttcaatttgggttgcgcattagagttacctggggaagttttaaaaaacaccaatgctcaggccacatttcagatcagtttcactgggggtgggatgtatacttcagtgtacagccacatttcagaatcactgggggtgggatatatacttcagtgttttctaagccctccggttgatgtgaatatacttttaaagctgagaaccactaagaaaacccatggagtccccagcatgtgcccacacacatcccctggcatgctctgccaaccctcaggtctactcctgctgatgaaagggcatgtgattctgaaccatatacccttcctattaaagtcaagagcatgtgattctgaaccacagcatcctccctcctccccagcctgcttcccccccagctccagttctcccaccttcccctgttacacagcaaaaccctaagcatcacagcaaaatataagagatgtgggctggagagccgagttatctgtgtcccatgtaactgctgccatggtagtcagaagagcagcaggtttagggaagaaaagggagaattggaagaggtgactttgtgatgggagagaaggaagaagcacattcatcccagttcaatccagacaggctgtcgccataatgaatggaaccagcccagtagggcaaccagaaggtactggttattacagctccattaagactatttaaagcaacaaggaacagctgtgaggaatatgatgcagcctaatgaagagcaaacatttgttcattttccagctcaggacggacacaccatatgtatggcttttgtggggaaggcctgtgttgccatcttgttcttagtcatctgtgggtgatggggtgatggcaggcaggcagcttttgaatggggtataactatagagatggaagtttcaggtcaccccaggtgctcccttctctgctcagagccccctgagcagtgtctgaggacacctctgcttctcccacaaggtttgttctcctcagttggtaacagagtgatgacagaatatcccaccacaggcaaccccagaaaggttctggttcagctcctcaatttgcagatgagcatggttctagggaggggcatgaggaattactggcccacgcccaaatcatgaatgggaaatccatggggttcttcaactctgggaactcataatgaccaaaacaggaatacctgggctccacctgctcgtttcactccactccaccccacctccagattgaaaaaagacaataggccattatagggagtggccaaaagccatcagtgaccgctgtggtttcaaacttgagagttttccagcaggaaagagctcacatggaagagactatggttatgatcatggaagagttaccaaggatcttggagggatctaggatcttggaagagttaccaaggttatgatcatggcccctggcagtctgcctcttcactgtagctggctgcaagtgtagagaagagttgctggcctagagtcagccacccagaagctcatgcatgaccatggagacacgtgtaggcagctggaagtctgtagcctgaagtgagttatggggatccccaaaattgtaggctcacagctgggaggaatagaggtaccctcgtgtgagattccccattaagggaaaagggaagagactcagtctttcccttttagcctatttttattgttctacttacaatattgtttctaacagagcacatggtgggttttttgtgtatttaatacaggatctcccccaaccaagtgagcaattttcaggtggtactatagaaaaatcctttgaccaagagtcaaaacctggtcctcaatctgctcctgagactctgggtggtcttgggcaagactcttccctctctgggtctcattttcatctgtgaaatgtttgactacaggcttagcatgaaattctaaaggctgatagtatatgcttctattttatgaacactaatctggccagaaacactgactgagtatttattgtgcacctaacactgggcactggagatagaaagataaataaagaaaataaagatgctgctttaaagaaagctcgtggtcttgccacaccatgtaatgatgtaacagaactctagttcaaatgctttggagacacacttgctttttgccacttcttgttgccaaaagctatcagaagtttcagaaaagataagactccgagttagagaaaagtagaagaagatgggtagaggagaaggttgtgtacaagagggaactacatgtgcaaagcttggaagcaaaaaacgaaatgattaaaatgctgcagccaatttttttttaggagaaacaaagatgcctgcctatgaaaggagaaatgaaactagttggggagatttaataggaatcttacacccgttgcacagttttcttgaaaacagttaccaaggttatgatcatggcccctggcagtctgcctcttcaccatagctggctgcaagtttagaggagagttgctggtctggagtcagccacccggaagctcatgcatgaccatggagacgggtgtagacagctggaagtctgtagcctgaagtgaattatggggatccccaagattgtagactcacagctgggaggaatagaggtaccctcgcgtgagatttcccattaagctatagacttcttgaaggcagggaatttgtcacctaaaggagaacttgtagcttttaattgggccttttaaagagtgttttgtgagtctacatgcagacatgcactcaacttctctgccttgatcaaagttcctgtcacagacaaatacccccatcttgctgcaatctgattttctacttagcttcaccagcagaactcataaattactgtctatttagtgacatggtatgcaataatatttgctctcctgatgccactctgaatagacgtcattagtcatcctctcctgccttctctgtccacatttataatccctaagtcttgtgcttttcagcacagaagatggaatttgttgaaagcttggcctctgccaaggccaccactaactcctacagcaccttagagtgaaataacaaaaggtgcacctgtctcaagatatttggctgtcaccttccagaaaatgttcataataaatatggaaaccctaaaatttctgccgtatgcatggtgctcccatagatgcaatgctcttcgattgtgcacaacctgcagagctgtgattcccttgtcacccacaagctgaccatcgacatcagtaaatgtgttaactgaacccgtggaccacaatagagaccagaccttaggctcccaacagattatgaaacgttcccattccctaaatgctattttacctatacctagagggaccagcttatcccaattttcccaaaacggtcccagttttaaaactgaaagtcctacatcctgggaatccctttggtctgaggcaaaccagaatagatgtttcagagatttcccatctttgcccttgtaagaaaaaagaaactggatgtttctaccattgtgaaagacagtgtggcgattcctcaaggatctagaacgagaaataccatttgacccagcaatcccattactgggtatatacccaaagcattataaataattctactataaagacatatgcacacatatgtttactgcagcactatttataatagcaaagacttggaaccaacccaaatgcccatcaatgatagactggataaagaaaatgtggcacatatataccatggaatactatgcagccatagaaaagaatgagttcatgtcctttgcagggacatggatgaagctggaaaccatcattctcagcaaactaacacaagaacagaaaagcaaacaccacatgttctcataagtgggagttgaacaatgaggacacatggacacgggaatatgacaccccagggcctgtcagggggtgggggtggggacaaagggagggagaacattagagcaaatacctaatgtatgcggggcttgaaacctagatgataggttgataggtgcagcaaaccaccatggcacatgtatagctatgtaacaaacctgcacgttctgcacatgtatcccagaacttacttaaagtaaaattaaaaaaaaaaaaaaaatccttgatgtttttgactgaagatggcaagagaatgatttctacaagtggaccaaaaaggctcaatattatatccctgggaaagaggatatggaagatggaagattctgggcacctactgtgtaccaggcattgtgccaggtgctatgggtattgtatcgggtagtcactaatcatcacaaaattccgtggggtgtgttattttccattttttaaaatttacatagtataaaattagttttgggagagtgtacagttttatgagttttaataaatagagtcgtttaaacaccaacacaatcaggacacatgagaatttcatcaaccaaaaagttaccttgcgttacttctgtatagttaaatccttccccacccataaccttcaggatgtattactgactcttttcagaaacgtttattgacactcgaagtggtgaacttatttgcagtaaaaatattcaaacattttagtctgtctgccttttgcaaagctctgccttttccctgactcgcatacacagttagtgtgcaagtgtatttcttgacaagacaaatgaaggaaagacccaggtaaaatggtgcctccttgctgaagactctccagagtgttccctgcaccaggagagtacagtgttggacaggggtgtggagaaatcctggcaggctggactgaacatggaggcggcaagccctcagctgtgccctggagcatcagccaggaactgcctcatcagcgatccctggcctggttttgctgcaccctagggcataacatatccaattatctccagggatacagtcaagcaaaggagagtgaaggggggcattgcaaatgacagaatctgctgaggataggaggtaaatgggtaaatgaaatgggctgacacgccctcagccttgaattgggagtgagctgctctaggaagctttgtgttttgacatcttactattttaggcataactcagaagggcttaggtgcaaagaagagtgtctaaagaaggatggcaagcttctgttggtttggctcagtagaaccaggtagaagaaaaaatcagccacacaggcatcagcgatcattctcagttctagcagaaaatgaacgtactaagtgggacattgaggtaggtttcatagtcctatggactgagtcagcacagcagaacacaagaagtctgtgacttgtggtcatgtggtctgagcctcccatgggctcagctctgtggataggagggtgggttgcactcgcagggagagttagtctggggcgggtaccagatgataattttattctaaaatctataaagcatatcatcaaggataaagaaggttccagtgacaagcactgtctgccatttatcatgatgctggcactagctcagcctacccctcttaaaaagtttctgggtcaggcgcggtggctcacgcctgtaatcccagcactttgggaggccaaggcaggcagattacctgaggtcaggagttcgagaccagcttgaccaacatggagaaaccccgtctctattaaaaatacaaaaattagccgggtgtggtggcacaggactgtaatcccagctactcaggaggctgaggcgggagaatcacttgaacccaggaggcagacgttgcggtgagctgagatcatgccattgcactccagcctgggcaacaagagggaaattccatcatctcaaaaaaaaaaaaaatccaaaactttcccattgaattataataaaactcacgttcttgtccttggtccacgagaccttgattgaacaccctgccccaaccccaagccaaatccacattatttgtcatcctcctcttattctctctgctctggagagcctccctttctagaggctctagaacacaaaaagctcattccatcccagggcctccgcacttgctgttccctctgaatggaacattccttccccagctctcgccaaagctggcatctgcttatcatttagtttttagctgaaatgtattggccagagatcagcagggacacacctcctggaggtgaacaagttgggtttatcacttgttgcaatgaagtgaatgcatacctggaagtgtgcattcctgtgggacatttcaggaagaggatgttaggaaggactcagaatgtgggctgtgtttgctgatttgaaagaggccctaaggaggtgaggctttgttttaggttggacacactgggaagtggtatgattggatatcttaatacatcttacctataagaagggaagatcagatagaggctagagctgtaattggcaaagaatcaggccgctcatattaaccagaatatgggggtgtttggtcatttttttggcttggacaatgttcatatctttgtctgcatccagatacaacttgcttttgtcttgttccatcgtggcctcagagcggccttgcctgtggttggtcttccgtgcaattgtccacgttcagcaggagagcaccaaggcctacctgtgagtgccaggtcagctcccagaattcaggggctgcttttctccctctcagatctccccttttcagagttctccccacaccaccctatctagtcccttgcccgggtccctgtctatcccagcacctggcatccagatggtcactggggaaggaaggaagtgagtgagggagggagtggggacagactcaatgtatattcttgggcaagtcatttcctgtctcaggacctcactttgctgatctataaaatgagtcaataattttctcaaaagatccttccaaatctgacttttgaggattctataaataccacggcgcagctctccagggataaggacatccccaaatacatcttttgaactaaaaaaaaaaaaaaaaaaaaaatgactgccttggaaaaacaacactgttgaagagtaggaaacatttccacactcagagaggaatgtaaaaatagggcccagcactctcaggagaagagaatgagaaaaggaaagcggagattgataatggatgaatataatgagatggcaattttggtttcaaaagaatgtgattagcgcctaatgactgccaccattccctggtcaatctactgtaactagccactaatggaaaaataatgcccttagcttgctcactttgaagatggaaatgagtctctctttcatacttttccccctcatattttttttgcttcaagagattatcccttattagattgtagctccctaaaaagggaaatggatgtgtgatcaaagtctgccaattacggggtcattaccactccctcccagaggctctattaggcatccctcctctgcttttatcaacatcatcacagcccccaggcctactcggtccccttcagcccccactaagggagacagaggctcccaggaccatgacagggcctgtgtggtttcccacgaactgccacccacttatcacaactgttttgttcggtttaggattgttgagggataggtgcatgctggggtgtctcctggaaggcatggtgtttgttgatggtgagaggaccccaaactgccattcaaggattctgggagtgaatacaagagactttcatgaaatctctgcaggatgtcacaggacagagaaagggcacacatttattctgtggggccccatgagatggcataggcaaagtgcagtgaggttgagtaaagaaaaaactctggtgagtctgtccaaaagtgaggccaaaagttggagaagtggtgagctatctgtcatggaggttatccaagtgatagatgctatggatccacttatcagctgcttggaaggccattgtggatgggaacacaactaggcaattttcaaggtcactgacacctctaagatcccaggatatttgccctctgaaagcacagaagccacctcattcactaattattccactcattcattcatcctaaataggtctttcaagcacatctgaagtatagagccagcatcgggttctggagatacagtcgtgacaaagatgctaccctttccttgaagaagcctatgaccaagttgagaaatagagttaaattattagatgcaaagaagtctatctaataatagaagtaactggctttacctggggatgcagtggggtgagggagagtgaacagagaagattccacaaagaagatgcttacgctgagttttgaaggacatgtaggagtttgtcagacggactcaggtggaagggaatttcaggtaaagggaacagcatgcgaaaagtcttataaattttaaacaccttataactggtaggatagatataagagcaagaagtgatgctgcaggggcatttggggtgaagtcattaaggatgttgcactaaagagtttgaaatttatcctgaaggcaatggcaagaggaatcactgggtcctattcacattttagaaagatctttctgattacagtggagaatggattggaggggacaaacccaaaacaaaaggaaccaatgaggagactcatgggaaaatattttaaagtcactatttgcaaaaattatggctgcatagtagcatcagctggggagttttaaacactaccaatgcctatgtcccaccccagagagtctgacttcattggtcttgagaaggaccttggctttgggagttgtaaaacctgcccaggtgattctaatgtgcagtcataaagagaccttaagctaatggtaacccaaaccctggcacatggcaagtactcaacgcaattattttttcaaaaaattagtatgaaaacagtcatgctatcctgcttttggcttcaccccactttcagggggacatgtttggttgaacaattggcttttatcacagagggtttcaggtacaaaatccaccctcaatagatcagctttgacatccagaagtccagtgctaccactgagagcagcaacctcccttcacatacagagaacagacctggcaagttgcctggaggagatggagttacctggctgggatagaagaggaggctagggctggaatctgagttctaagagttacctgcagtagctagaagcatcttccacctagagatggcctaaactggtggcaatatggatgcaaggtttggtagaatgaggagcaagaagagaaatacgaaaaggagaagaaggagaaagaacaagaggagaaaagtgagagataagccccacatttgtgaaatgagcacttacctatccttataacatttttgccatacccagatttaggtcagagattggtgcccaaaacctagcacctgtattgcttctcttccaggatgtttgtctaagggcgttggacacagaaagaacaaaattatgacccattaatagctaggaaggcactttattacccgaatctaaaacctaagaaaggctaagttgtagaacatggctcagcctgagaagcccaggaaaggaactccttcctgtgccctctaatgaatcttcagttgctaggtagcagaatgagcactaattccacctactcagccactgcatagatgaggatcatagtcatgcttctagaataaaggtcagcaagctatagccataggctaaatccagcccaacatccatctatctatctatctatctatctatctatctatctatctatctatctatctatctatgagacaaagtctcactgtcacccaggcaggagtgcagtggcgtgatctcggctcactgcaacctccacctcctgggttcaagcaattcttctgcctcagcttcctgagtagctgagagtacaggcatgtgtcaccacgcccagctaatttttgtatctttagtacagatggggtttcaccatattgaccaggctggtcttgaactcctgacctcttgatccactcacgtcagcatcccaaagtgctgggattacaggcgtgagccactgcgtctggccccaacacctatttttgtaaatagagatgtatttgaacatagccatgaccatttgtttgatttttatatgtgactgtttccactctacaacagtagagttgagtatgagttgttgcaacagagactacacaactaacaaagcccaaacttctttctagtttgcccattacagaaaaagcattccaactccaactctaggaaaagactcacccaggttgacttaacacttgagagaccagatgcaagaaaggtagaaccatgcatgagcactggcctgttaagaacctgccaataaaacagggcttattgaggggctgaatttctgatcaacctggttcaggttcctccttgcttaggatagacctagtaaggaatagatgggcaaaggcaaggctggtgtattaaaatgaatggtgggttctcctcctgcactgctgacagagagctgtgtagactgaaggtgttacaaattcagtctcagaagcaatgaaagggcatgagcaggatgttcagcctattctactaaatttagggtagagagagtaatcaaaacatggtctgataatcatgcttctgcagcttttctatagctgttcccactcccttaactgcccgtcctccctgtctgtgaaataactgactgcacccttccctgtgtttccataccacttgactcataactcttgtaaattgtctcatgtttgttgacttgtctgtcttatcggtggttgccatcctcttaaactgattgatgacttctatctcttccctatccctaagctctgggtgtccatgtccaacttcctattcaacatcagcttggatgtctaatggacatctccaacgtggctgccatttttgttattttgaacatgtttttaaaaaagtgtgcagtattcaatgctaggcactctactaagcactttatgtacccaaaacacaacacttaattcttacctccccaatcctgtttctaacccaggcttctccatctcaataaatcacatctctcccccctcagttcttcaaactaatgatctaagggtcagccttctttcctctccttccttcacagtcaggatctatggcagatggtgccctgcacacatccactctacactcactgttcccacgcatgcccaccttatggcttcctcctgtaagcacctgtgactttttgcctgagggcttcttcaagacagaagaatatgcacactctgcccacagagcatggaagaaatgctggggagtttccaagagttgtcctcaaccaatactggatgcgaattgatcagtaactaccccaactttgtgccaaccccatggtgggataactctaaggcatgagatgtgcccattggattaggccccagttgcccacagtggtaacctgctcattgatgtgctctatattgacttcattcccttgattgtgccacttccacattctcccacccaaactccctgggagtgcctcccaaacaaactacttgtgcctgacttgttatctctgagtctgcttccgaggcaacccaagtcaacaacattcaactgaacatcctgcaaataatcacttctcatatgtccaccaccacggtctaagagtccaaggtaccatcatgtgttgcctggagtactgccacaacttttttttttttttttttgaaacagagtctcgctctgtcgcccaggctggagtgcagtagcgtgctctcagctcattgccagctccgcttcccgggttcacgccattctcctgcctcagcctcccaagtagctaggactacaggcacctgccaccatgcccggctaatttttctgtacttttagtagaggctgggtttcaccgtgttaagccaggatggtcttgatctcctgacctcgtgatccactcacctaggcctcccaaagtgctgggattacaggcttgagccatcgcgcctggccactgccacaactttctagcagatctccctgcttcctccatgcccctcccagagcctgtgttccatacatgagccagattgtactttgtaatacatgaatcagatgattcccctgcccaaaaccctctgatggtttttcatcacacttagaataatgcccagttcattaaccagtaatagcaatgtcttatataatctggactcccccatccgctctagatacttccatcactacttccctcttcacaacactccagtccttgaatatggtcatttggttgctgcctgaccatctttgcatctgctgttccctctgcctgaaaagcactttctacttttcttggtgtgactggctgtttcatattaaggaattacagtatcatgaaggaattatagtatctatcattaatgaagtcccccttatctgcagttttgtttttcatggtttcagttacccaaggtcaatctcagtcaaaaaatattaagatatttagagagagagagaaagactgcatttatataacttgtagtatattgttgtcatactattttattattgttcttaatctcttgctatgcctaatttataaattgaactttatcataggtatgtatgtataagaaaaaacatagtatgtatagggttcggtaatatccatggtttcaggagcccccccactggggggtctttgaacaaatcctccaaggataagggaggactactgtaactaaaatgttaccttcttggagaagccctcccagagtgtataatctgaaataattctcattcctcatcactatccctttattctgctttattttcatcatagcatttttcatatctaaaattacacatttactcttttattacacatttactatatttcctagttgactggaagctcaaggggaacttgtctgtttctctatatccctagtacctaaaacagtgcccagcccatgttaggggctcagtaagtatctgttgagtgtatgaatgaataattcaatgaatggacaagcgattcccccactgggctagattgtgaactcatgacacagaagacatcaataacatttgaaacaatgaacaagagaataggtccagggacagacaaaatctatgtcctccccaggccccatccaaggacatctatccctttccactaggagtcccatcgcagtgggtcttactttgccctgttggttcatctccacttccataaagctcctatctcaggccactctaaccactctgtccttgctttttaggccttaccagaggggcagacagcttcgtgggacacagccaaggaggatgaaaaccgcaataagaatcgatatgggaacatcatatcctgtaggtgcccttctgggagctcctaagcttcaggtgttgaggatgcaggggaaaagaggctattactattatttacctggaatttgttatcaaataatctttgctgtctctagctttgtatctacatgccaagatggaagctttatatcagccttactgccatccctagactggatgacagagcatggctgatctcagccagagggagcaggcagggagatgggtcagggcagagcagaaccatgaagcctcttggggaagaacctctgaaggctgggtctcaccgagcattgcctgctcaattcctcaggtcggggaagaagcccagccaaaagggctgacatgcggaagaccccacagctggataaagagatgagctctgtgttcccagaagctcctctaattcaaaggaggactttggcagcaacctggggtgaggagcatgggccccagcctgtgagggaggggctaggagaacccgggcaagagaatgatgctcctccaagaaggtggagtcacactggctgatgcttggaagtaaaggctgatgctcagaagaagccagtaactctggcatacacctggggcttggggtatgcccagctcaggcctcacaggagcccggggctactcctatagtatgagagacagagtttagggcaacacagattctacctgtccccactatagtagggcaggggctctgaggtgagggcctgccctcaggtctgcatcagtgcacctcgggaggtactgagcctgcaggggaaggcatgttacgcagagctaaggaaggacattgcctttgctcaacaatgagctttacctttcctgtaggcacccccagtgaatgactcattgatgaagtcagcggtgcagagtagttagcgccctcgggagtcaaactgcccaggtttctatcccaactgtagggccctgggaaagttacttgacctctgtaaacttttgattcctcccctttacaatgatgaggataataggaggagcatttaaaggtacataaaactcttgctacagtgcctggcaccattactcttagccacaggggtacttgcttgaggtcactggtgagcagcatggatctatcattccaccttattttattaaccaggattcactgggtactcaggacatgtcctgtggggacatagaataaggcaggttggttggggagaggtgggcatgatcagatgtccattttggaaagatcactagggcagcagatatggaaggtatacttgattgggaagggctggtagcagagggatcagtcagcagactactgcagtagtctcaccaagggatgatggggcctgaacaaacagtgacaataacttgtgtgtgacaggtgcatggtattcagttctggggggtgaggaagagagagactgccacagaactgaatgtcatgcataggtaacacacaagtattgtcactgccaaatattcgtaggtacagccttcaaagtaaaataaatacagagaagacaaagttatctcgtgcaaaatgctaagcatgtattctaattagaacaggagtctacaacagcctttgtctgactcagtgtaaccaacctggaccttttgacatctcaccaatggtgtggggaacatccctgggtctcagctcacagagtaacccagttcatccaaaagaaaaaaaaaaaggatcctgaatgacaaattatttctagcacaattcagagttttgttttgttttgttttgttttaactgtctagacattgcctaagaaaaaacttggaggaagaaagagtaagatacaggcagattgtaaaggaagaaaaaggcagaagttttagcttagctgtttcctgtgctgatttaggaatgggctatgaatggtagaactaatcagaaaacatttataatttctctcttggaagatggtaattcagacagcaagatttcttgcaagtgaagtgttgagaagtgatattcaaacagtcagcaaacatgtattaagacttatgacatgtgggcctcctcaaagcaggccctgtgatgggcactgggaggtggagctcctgctcctggggagcccccactctgccacagggagctgcttgccctgtctggtccccagcattctctgctcctgcactgtggacactgtaccctaaaatatatagtcacttatctgataaagcctatgcctgaggctctgagcttgcttcaccctagccctgccctgcctgcatctcttagactgaggactttctccaaagctgggaaaggatcccctgcccaggcacaggcagcctgcaaatcctgaagggttaatacccccaggagaagccctccaccatgaaataccccagcttcttcaccgttctcctgaagttccttctggagttcccacagggatgagaatacagctacctgcagtcctaatgggcttgaaaactcacccttaataagctgccttctcttccctgtcgtacatcacccctttcctactggtattcctgtctcctcctacataaactgcttggactaaaatctctgtcttagatctacttctgaggaacccaaatggagacagagagaactgaagcaccttgacgataccaccttgatgggtttaaataaaccagaatctcctttctaatttaagagtcaatcattctgcaagagatcagggcaagagcaggtctgcattcagtgctgaaagaagacagtgccgaggtaaccagtgaattcagaaagcagcgcaagacataaaggagaatcaagaaaaaaagggaaatggaaaaaaaacaacctggaattgaaatgggatatgtaaaaaagaaacagccccaaggaatggaaagtgttcctgcccttgtatgcgtccctcccaaaggcaaagcctgccgaggcttgataaatagaaatattcttggcgcaagaagaaaactggctgtgattagcatcttaaggaacccagagcactgtgaggctggagtggaggacaaaggcccaggccagggagaacagaaaagattaaaggggacaagtaggagggagggcactgcctacaaaagaaacaacaagagaccttggcgaaatatctcctttcttccaagtgattctatttagaatttagtaatagagacagtggggtttctagggagtgtaaatggaaaggaagtgaaagggaaggaaatgaatgggtaaaataagaacaaagagacctttgcttccaagtaactctagggcagcgactgttggcaaggggaaattcaagaatcccaaagcattctccatgtaaagttttagaggtgcttcctagactggcaggaaggtgctgacactgagaagctgaagtgatcacaggggttgcaaatgttacaaaatgaggcccccttctgggatcagttctttataaaggtgtaatctagatgtagaaagactacaagggatagtgcagtaccaaaattccatcctcagaccaggaaggattccgtaggaggggttaccaggacccaaagagagatgacctgaccagaggtgggtgcgacctttggtggcaaggcagccacccatggtgaccccaccaaggggtgctggaggagtaagtacctccatcacactctcctccctccacccaatcttctgcctgtgctttccattggctggggccaaccagaatccagagaacaggagatctgttgacctaatccagtggttctcaaagtataatgcctacagcagtggcattagtgttacctgggaactcattagaggtgctaattcttgggctccaccccagacttactgaatcagaaattctgaggacagagtctagcaatctgtatttctagaagccctctaggtgatggtgacgcatgtgcaactttgagaatgtccaatcttggccatagcaatcagcctcctggattagagggccagatgaagtggagagggggtctgcgggcacacaggatatcagcacattttctgagacttatcttctcccaatctaggaaaagccactgggctcaggtgtattggggtcttagacatgaggtcaggcagtcccaggttttcatcccagttctgttgtttaccttcagcacaatcacttcacctcacccaccttcaggttctcacccatcagatggctctagggcagctctcaggatggagaggccaaattaagctgaatgattattaaatctgaatcttgtgtggccccttaagtcacagacttttaagtctagatgagttagtgtagcctttttgagttcacaggcaagaagagagagcccagagatggactgtgccctgcccgagagcacacagcaagtctgtagaacagccatgaccagagctgtggtctcttgcctgccagggtagggtggcacatattccttaccaaagagtcctctctgcatcaagtcacatccatgttcctgggggagaatgtgttgctaaggcccaacctcagagcagatgagctcttcagagaggcccatcttttccagaaggaggtggggctatggagtgcagagaggaccctcactcctagtgaggaactcaggttcaaaacaaaacccagaggacttttttcacagcaggtttctctgctgattcctggggagacagagctgggggtgacagagtgggtgccttattcaatgctcctgactctcagcctccattcttcttcactgtctctgagggtggccattgcctgggtcctacagatgccttgtggtgcagaaaccattggtaccctgccatatccccaaacactcactacttgcatgtgtgctagtgctaattcaaattgccagcacctttgcttcttttcctaaggactttttctggccactagagccttctctgccttcttgcagggcaggcccaaagagccagaatattaaatgtccccagaacctgccctcaattaatgactgatggaagtgggtatatacataccccagctccctctctgcttaggtagaatgactcccagagctcctcagccgaattaagcctcaacttgctacaatggcaacttgctgaatgacacacccctattagatttcttctttctctgtctcacttcccactcccctgctggtgtttcctgggatcaccccccgacaacaactacttgcatccaaatacatatctcatgttcttcttttgaagaaatccaaataagaaacctccctcccttccttcagaaaggcccctcagtggggcagtgcctggatggcatccttaggacacaggtggtcctctcttggtgcttgcccctctcaactccagtccccttcagtcccctcaaaggttgcatctactggagcagctcctcccaggaccccacaaaggggcgttttccaatttcagccagcatggatctggcaggacaaggaggtacacagaatgtcgggctgtctctgcatcatgcccaagccagcctctcttgataatggtaattcaatcaagattgaatgtgcagacctttagcttcagtgaggtacccaggcagtctcagcagaattacctgcctcctccttatccacttttgcaagatgatggcattaacatttccaatacttgtaggaaatggtttttcagctccacaattcattgtaatgagtcaaatctcttttctctgaaaaaaaaaaaaaaaaaaaaaaaaagcactgttctttaccctctgtagtgcccagaagacaggaagaaagaatatcaagtatccaaataatattctctccccagccccacctctttgaagtgattctctctttaagtggatgtgggttgagatgacaggtttactgggctatctttggtgatggagggagggagaaggagttgtggtttgttctgagagttagaactgtatgaaagaggaaagtgaaccctctctctcgggtggccatgagaccttagtgggatgaggaccaatgttggagactgagaacttagaggaaagtggaagctggagaagtgtggcatagaagggtatggaggtcatggatctcagcgttccaggaggagtgaggaccctacaactctataaagaagccctcatccctataccttctcctgagttattaaactttttggagccttgaatttctcattcatgaaatgggatgatggtatagacctcacagggttactgtgagaatcaaatggcatggcatccccatggcatttgataagtgcctggaacatcttacacttttcacacagctaaatttccgtatcccaccacctggcacaaggtgagtctctagtcttatggcccatttccagtaagatcttctggtctttcccaagacagattgaagtgaataaccagagcacctctgcactaagtcactaaacattggtctgtatactcaaacctgaacgtgtatcagaatcacctggagggcatattgaaatgcatattgatgggccccaccccacagtttctgattcagtgagtctgggctggggcccaagaatttccatttcaaacaagttcccaggtgctgctgatgccattggcccaggtctagaataaaaacaaaactgaatttatatagttgtgttaatttcttacaacataccaggtgggttcatattttacatcttttaatccttgcagcaagtctgcacagctatatatgatttggatgttatagctgggtaaacagaggctcaggggaggtggtaacctgccccaggtgatatggttagggtgtgacaagcctcaggtctgccttcagactccacccaatccataacctcccttctgctaaaggcaagaattggctgccagtctttggaagggataggctgggtctacaggtgtggtgaggggtcagctatgaggagaggaagaattggagcccaggatccaggcgcaactgccagcttggatggaggtgttctttgaacatgcaaaggccctgtggtcagagtgaacacagtgcatttgagcaactgaaagaagaccacagttatcagagcagtatgtgaagctggagagagaagtaggtcccaaaccatcagatcatgcaagacattgcagggtgtgctaggctttgtcctctgtcagtggtgttctgtagctgactcataccagcttgcaaaagcagattgttaaattttcaggaattttgtgaggtggttgatgctatgttggtagcttgaaatcggtcatggtgggagtatttacaccacagaaatcagcagacattactgatcagggccttttttcccacagggagctgtatgttaaacatttaccagcatactagtggtctttgacctcaagcaaggaacagcagattgattgcaaactgagtgatgatgttcccctagacttgtgttaaagggagctctttgaatttatgtgtcttggtaccatgtctcccttctaccttctgccaccagttccctcctcgccacagccagctcttgcccatctctcacctcaactgagagccgggggagccaggctgcaccttcccctcgcctcattgaggagtttgcttctcctccacatgactcttcttaactcctctccttgtcttgaatatcaaacaaggagtaccaaattagctgtttttcaagcttgcaaaatgtagatagagcataatgaacattctaggctgcttgtaaattacctcgtataaacgccttcacatcgcctgccgccccatctttctccatgtgcatgtgggtaaacacaattttttatccttctaattatataaagttagaagaagaaggggacacagaataatattagcatctcccaaaaggaataaataaaccatgaggacactgccactccttgcagtgcctttgtggtggacctacagctgaattccaccctttagtgaacacacacaatagttctttgcctctgcagatagatggatctgtatttggtacagaggtcaagtggagagcaccaagtttctaagtatctctgctattagctcactgcctgcctcacattcagccccaaaaccatcatttattaagcacctgctgtgtaccaggcattgtcctagcatttttctttagagcagttttaggtttacagaaaagttgagcagaaagtacctcattcccatgtactccctcccacccacatactgtttcccctattattaacatcttgcattagtgtggtacattcattacaattagctaatattgatttattattattagctaaagtccatagtttattcaggtttgctttttatgttgtacagttctataggatttgacaaatgtacaatgacatatatctactattgcactattgtatagaatagtttcacggccttaaacatcctctatgcttcacctattcatccttccctcctcccaagcccctggaaactactgatctttctcctgtgtctagagttttatctttttccagaatgtcatatagtcagaattgtacagtatgtagccttttcagattggcttctttcacttagaaatatgcatttaagtttcctccatgtctgttgcagcttgataactcatttctgcttctcactgaaccataggccattgtatggatatcgaatgaatgctccttcacttacagtgaggttatatccccataaacccataagtttaaaatatcataagtcaaaaatgcatttaatatacctaacctgacaaacatcatagcttagcctagcctacgttaaacatgctcagaacacttatattagatgattagttgggcaaaatcatctaatacaaagtacattttataataaagtgtagaatatgtcagggaattgattgaacactgtaccaaaaattaaaaacagaacgtttatatgtgtactcaaattaaggtttctactgaatgcatgttgctttggaactatcataaagtcaaaaaaacctaagtctaatcatcccaagtgagggaccgtctgcaccacaatttgtttatccattcacctattgaaggacatattggttgcctccaagtttttgcagttttaagtaaagctgctataaacatccatgtgcaggttttcctatggacataagttttcacctcatttgggtaaataccaagaagtacaattgctagatatagtatggtaagtgtatgtttagtcttgtaagaaactgtcaaactgtcttccaaagtggctgtaccattttgcattcccaccagcaatgaatgacaggtcttgctgtgccacatcctccccagcctgtggtggtgtcagtgttttggattttggccatcctaatatgtatgtagtggtatcttgttttaatttgcaatttcttaataacacatgatgttaaacatcttttcatgtgcttatttgccatctgtatatcttccttgattaggtgtctgttcagatctttctcccattttttaatcaggtcatttgctttcttactgagttttaagagtttgttgtgtatttttgatacaagtcctttctgagatacgtgtttggcaaatatttcctcccagtctgtggcttatcctctcatttcttaatgtcctagcacttttcacacctatgttttctcatttaatcctctcatgccatatagtattggctccattttgctaaggaaaccaaagctaagagagatcaattgacttgctaggtgatggagctaagatttgaagccaaatctgatcacagctccatatctcacgtcttatattaaaagtttatctcacttgacataagttagctgtgtaggcatgaattttggttacatcataataaagcacctttccactgtcccagaaaagaaacactgtattaggctgccctgcagagcccagcatgattccttgagtcttcatggcttcacagggcatggagagccttctgaaatgaaacccccgctgctgcctcctctgtctcccctcccatcgctgttcccctcacactctgttttcccaggacaggagacccttgcagctcccccacggtgcttgcttttttcaggatatctgccttcactctagccattccctctgatggaaagacttcctcattgtgcactggccaaaccttactcatttttaattcctcattcacatgtcactacacaaagccctctattccccatcttctagatttggaagttttgcttctgcatacagtctgtctccactaaattgacaaactccttaaacatgagtatcacatttgatagcactttcttaatcccttcaactagcctggcacatagtaggtgtgcagtaaacacattcttaataaatgaaggagagacgttgtcaaacaccatcatctggtggctagagatcactttcatccataagtacacttaactagaataaataagttcgtttctttttgttttgtttttaatcatttttgctttccggtttttcaacttcattttatattttaaaaattccctttcaacattttaaaccacaatctctgtttccagtgctatgggccccaggggcaggcataactcaacaaataaaggagatttctgaatcagtaagtcataatgagaccactgagtgaaaacacaatgtgcattttcacttttttgaggcctacagcttctggaactgctggtaacagaggcttgatgccctgggctgagagtcaggtgccaggctttgtctgaattccagcctgctggatgggctgtcccccaggaagtcctctctggggctagaatcctgcaggaactggggaagagctgtttgcacacactccagctgtagtgcctgtgagatgcctgagactctgggacagcaagttatgtgggcagagtagggtttcagggtcagataaacctaaccgagaagtcctatctctgccacacacatgatgcgtaacttcggaagcttgcttaatctttctgagcctcagtgtcttcatctgtaaaatgggaagactcataataccatatcattctggtatccttataataacctatatggctattttgaggcataaatggttgaaggagataatgcatgtaaagtttctcttacctaccatgaatccaataaaggttaacttcaaactcctcccccatgtcacattccactctcccactcacccaaagggattgcttagaccacccacctgctccctctagttgcttctgctgaaacttccccctgatgagtaagaaaagtcgcatttagtataacttgctgtctagcacagtgcctgcctgccacatggcagatactcagtgaatgattcttaaatgaatggatagatatggggtgtatcttataccagccctaggcctgtttgtccataataggacccattccttaccttctcccactctagtgtgcattgcaggtaacttacccctgcaggttgtgtttttcaggctctcctgtcagctatttaggtttagccaatgacatgcactgggagattggagagaaggagaaagggagaagccagggtattacaactacaattgccttccttagcagcaagggaagcacctccttgcctccagctcctactagaatcccactgtggcttcaggttccagcaggtggccccagctcctgagcactgccaactccaccacctccctccatcccttcagcccaagggcaggcagtgtctccttgttgctgcttatctctgagtttctccactttcttctatctggctgctcaactctttgtaacccaggcaaccacttctcagtagttaattccctctgctgggtatatctgaagtggtttctaacattgtgcttacaccccctttggaaacaggagcgaccgaactcagagttaagagaacttcactcctctgtgctctaccattcactggccatgtggccagtcaggctttctggagcctcagtttcctcatttgtaacaagggctaaaagaacccatcctacttctcttccacagggtcactgtgagaacccaatgagggcatccaattataccttttccatgtactactgagtacctgctgtatgtcaggaccttttaaaggtgcaggggatggaacagggaataaggcataatgtcccagttctcaagggggttttggttaattgcaataaatgtgccttgtaaactgcagaatgctgtataattctaagaagataagctgatctgacctccgtgactcccagaaaacccttggggatgtccagagctctccagcccacatcttagggacccattcctgccctagaggaaggtgaactaggatgcagtgactgcacaatgatacgtgcacagtgacctggatagcaaaccaaggtccctcctcccaaccagaccgaaccaatgttccacttgtgtgtgtctattagcgtgtcagagctcacttaattaactgtaaaggattatcctgattcttctgctgtactggttttcttttaatggtttttatttggtgttagttgaagtaagcatgctaccaaataaagcctgcaaatcttgtttatgtctagatagtgtttgaaaaggcatcctctataacacaatttttagttattgatgacctcttttataatgatttagtcagcctcactttaatgatagtattgataacaatatatggctgacaatctatctctaacaatactccaaggggcaaatgaaaagcaatttgtgcatgtgtggaagataggtaaacttgctgtttttaaacaacatgaaaatggagtatattaatccagatgcaacactctcctgtcctaagcatttttatatggtctctctcacattgtcctatgaagcaagtatttccatccccattttaatgattaagtcactaagacttaaagaaacaggtgactaatccagttaggtaatgacgaaatcagaagggaaggtagaaaaatgagaagtgcttacctccctgagcctccacttcctcatctataaatgggagcagtaactgagggtggtgttgagagttaaatgagagtagcacaatgcctgatatgcagtcattaataaacagtagttctaaaggaggacattagctgcgtaaggcctcttatcaaccatccccttgatttctgctctctctgcagacgaccattcccgggtgaggctgctggtgctggatggagacccgcactctgactacatcaatgccaactacattgacgtgagtgtcttaatggggctgggggctggggctggcttttgcaggctcaagatctgtggtttaccccaaactctcctccagaaggtggcccttccagagcagtctggatcctccttgatatgtggaactagtgtaacccaagttgactgtccatctaccactgcatccactttcaggctagctgtagtagcctgctctatggggcctcaggacaactgttagtcttactcattcaccccatttattcatttgtgtatatgtctgttgatccattcattcattcacataaacgcatggccatttatgccacaaaaattttaaagtgcctactgtaaaatgtatactagatgctatgggaaccataatgctaataataccatggtctctaccctttaaaaccttagcagggagataatgtgcacatcaataattccagggcaaagtagaaattgttaagtgtcaaaagtacagataacatgctgcagagattcagaagtagggaaaaatatcacttctcccatcaggaatgcaaaatatgatgtgaaccaaagcttcaagcacagatatgatttaaaatcaaagagaggggagaggggcctctggttagagagaatagcacaagccaagatggagcaactggccaggagatacatagcagctccatttgaggggagcagagaatatgtaacaggaataatggaaaatattgttgggactacatcagtgaagattaaatgctcagacttaggaagtgggactttatcccatagacaagaggaagctattaaaaattttttatcaaggaggtgaccagcttagaactgagctttggcatgatttatctgctaccaaagataagacagatccgagggaagaaattctggaattaagacaactacaaccaataaggaaagaggctgcttcaatattccagagacgactgaggaagggactaaactcaaacaggagccaagaagggtatgcatggaagtgagagaatttgctaagcaagagcatgactgctgaggtcagaaggacaacccaatgtgactgattcaagccatgcatctcaggacctcagctcacagtccatgggtcttgaagaatggcacagagattcatactggtcccctagactctcaaatgtatttatagataggctataaagtgtggtggtgcagtttgtgaattcccccttaatctagactaagccaggtgagttattaactcaacaaatacttattgagccttgtattgatcatctgactgcttgccctcagatctattttgtgtccttccctgttctgccttgcattgcagggtgtgtgtgtgtgtgagagagagagagaaagagagagagacagacagacagacagacagacactggaggatgatggaagggcagtgtattctccatctcactcccttccttgggcagcaactccagcagtggctgtaccctgtctgtggctccatctttcctcaagcaggcctgccatagtccagtctcctgccagtcagcccactggggctctggttatttctggactctggactctagttatttctccctctcctgttctcccactagttctaagggttggttgcagcctactcctgtccctgatctctgggttgccccactattctctgtttggcatcttggctcctccatcacttgtgtaaccaactccccatactgaattgcctcgtctgaaacacatagactggtttctgtttccctaactacaccctaattaacaaagggcctactacatggccaagaactgaggctgcaacttcagtggagttgaagatgaacaccgtctctgccaccatagcccttccagaaaagttcacaggagacagccagttctgaatagcttttctccagcccagagcaaggcactctgagcatacatccatcatgccagcagcctttccttcatacatccagtattcagttcacaaacacagagcagaccctccactgtgtatgggaaatactgacttttaagaccaggtctctgacctaaaagggactcaaatctggtgagggagtcagataagaaaatagaccttcacagagcaggggctgtgggaccataaaggaaaatcaaagcttcaagttggtgggaaagggaagtagccagtgaaggctccctggaggaggtgatgtctcagttctgccttgaaagatgacttagagccagccaggcaagaagggtttatagtaacctaagaattactgatcacctttcatgtaccaacatcaccttaactagtatcacaacttcacaaggtaagtaccactactacccatttccagatgagtaagtgagtctcttaagattatataacttgtccaggattatactgctaggaggtaggggaggagggagcagaaatttgagtcaagagtacctctcccaccataccctgctgtctttaataatcacagtgagcaatgacaacaccaactggctcttaatgagtcactcttggggtcctatgatgggtggctcaagtaagtcagcttatcaaaacttcttaacaacccttcaaggtaggtgttctcattcccattctccagatggggagggctaaggtttagagaaatcacaaatacgtctcaggccatgcagctggtcagtggcagaaccaggatgggaaccagacctgaatggctcccagtttagcactctttctccttcccctccccccccccactcccagacaccgccttgtagccaacacacagcaaggaccgagtcagcatatattgatgcaggttgaattgattccttccatttctcctcgaccttgtctatggctgcatggatatgaccctaaggaccacaggccacacagggtctggcatgcctgagtttctgtatctggcattcatcatttgactagaatcccccaacaaaagtcattttcctagataggcactcactccaaagttgaatgagcatctgactacagtcagggccaagatacactttggtattttataggcaacaaacgaaattgctttaaatgcaagttaatctctacaactgctaattatgcctctgattcatttcctgttttatcattgcaaggcatgtttcaagcctttaaagacaggaaaccagagctgtaggttaagagcactgtccaaggtcacacaactgaacttcagttctctgcccacttaggacacaccacgaccttcttcttctgtctgtaataggttaggcagacagggcaaatggcctctgttcatgctgtcttattatgggatattgaactccaggctcaatctcagtggttagaatccagggccaataaagtcatgaatctggtctgtgttgaagacctgtgttgaatccaggcctttttgattactagctttatgatcttgggtaaattacttaatcattctgatatctataaaatgagataatgatgccaccccacaagtgtgcaattactgatgtaaagtatctgtcatgatcccaaaaggaaacataggcttccccaaagtgggtacccagggaaagtttaataaggatgtgaacaggattaagagaaaccagtagggtagggtgcagtatcactaggctaacaatagtagggagtccttaccagccctagacccagataagggaagagagtagctatgagagagggctgcccttcaagaactgaagcccttgattgagtgacaaggtcaagcaaggcatggagacctggcagggaggaacctagaagaacatatgccccaacctcctcctggcctctgagttcctgcttttgttccccattgactaaacccaatttgaagcagaaagaataggagcccatggcgcgatccatacagagcagaccatggaaggaaaaaggggaaatggagggacaaagggaagaaagccaaccacaagcaactccttgcacagttaccactatagggtgaagagtagaggaactccattaattgtgaaccaactacatactccagcaaagataaaattcctggggtctctatagggattcctggcaaaacagtactccagacagctaactaggtcctcactccatcaccctggtctccaacgcagccacaatccttcctggctctctaaagagctaactgcccatgctagaatcatttctctacaattggatcttgacgattcattaaaataactccattgggacaatgagctgaatggggccagccctgtctctgcctccggaggccgtggtctgttactgtctgaaccatcccgctggcaggtttgtttgcacacccgaaaatgtattggccacttaaatctgttatgaattaccagcctggaaataaatatcgtatctgggtccccagtaagtaacagatgcatgagtgcagagtgagataaatgcgttttggatgcaaacctctttcccattgctcacagacagatggaggcaggcccagtgctggtttgcagtcaatctgcgtgctgtgtaggtgggacttaaatgaactcaaagttcttttaaggttaggaagttttctgtactcgctcttggcgaatccccagaggagccccaattgagcagtacgtttccttttatctcctttgctgaggagtctcgtggttagaatgttttctctttggggactgcgtgggtttttggaagccaaggagggtctctttactcagatgcagcgtgggaacaggcacacagcatgcgtacattcagtcaatatgaatttttcaaggccaatggcccaggctgacttgtaggtgctggggacatggccatgagcaagccagccctggcttcatggagctcccattcaactgggggagcatgtaaatgaagaaagaatagtgtgctatttggtgataggttatctaacgaaaagtaagccagagaaagtggaaagaagctgatggggtggtcagagatgaactctccacagacgtgattgacaactgagcagaagcttggatggagcgagagagcaagccactcaggtacctgggggcagacatagcaggcacggggaatggccagtgctaaggcctctggatggacatgtgatccctatctctgaagaagagcaagagccagtggatgatgaaagaatggcagagaaactgggaacatcactgaaaggatgaaatagaaatgacaagaggtgtcaagatgcccaaactaggtttaaggagccaatcaaccaccacctcctctgaggggaccctccttggctgttcaattcccatgggtactccacagagtccccacatcttcccattagtagcctttaccccagtctgttgatgtctataagttgctcaaaagcaaagtccacattcatcgggtccacttttgtatttccagtgccttgtacatagtagtaggtgcttaatacctgttgattgacagtgaataactgtgcaaacaaatgaattcacaaaatagagaatccaagccatctaactccacaactaaaatgtgaatctcttgctcaaaatgttatctcactgaatttcaagcacattagaatcttccaaatcacagcttcctccagggtctctttttcttccagcctgagcattaagaggatgctccaacttcagctcaaaaacattcatacatgtatttcaccaaccagactgctgaaaactgcacccagctctgggtggcatgtcccatgtcccaggaggagaaaggtacaaaaaaatttactgcagcacatggaattgcattcactgagcatatacaaagccctactgggccactcaggaggaatgagtcagctctgtatcccagaggagagcatatttcaagagcagcttggtgaggctgaagcacagggtgcatggggttgtaggagtggacaaagagggacaactggaggtgaggctggagatgaaaatggagacagatgactagtccgaaggtaaggcatttggcattaccatgcagacaatagggagctactgcaggcttataagcagggaaataacacactcagtgtgcaagaggaagctcatggggttaggaagcagcaaggctacagagtgaaactgcaggcagggaagccagctagtggttggtgctgtggcctcagccagggaggatgagggctgtgggaatgagtgatgggaatggcagaagagggcagacttgagaaactgcatctttccaggatctaggggactattttctattcccaaagctactcaagacaacccttgggtttaattctttcttttagcctgagcagccctgtccacttgacttggaggaagggataggtcttcctaccccttgtgtcacagggaagggctcagttattacattaacacaaagaaggtctcatcatcccagtgtcccctgagaggcctgcatacacttttagtcttgataggcactcagtaaataaatatttgccaaataaacaataaaataacaatagcaaagacatatatgttaaatcttagaatagtgcctggcacatagtaactgttatatatcaactcatttaatctggtcaacaacactatgaggtaaataccattatccccattaattttttaattttatagatttagagagcacaagtgcagttttgttactgtatgtattgcacagtggtgaagtataggcttttagtgtaaccatcacctgaatagtatacattgcacctattaaattatttctcatccctctcaccaccctcctaccctgccaaccttctgagtcaccaatgtctacgattccacactttacatccatatgtacacattatttagctcccactgtaagtgaaaacatgcggtatttgactttctgtttctgggagttttttgcttaagataatggcctccaggcccatccatgtatccatgttgctgcaaaagtcatgatttcattattttttatggcttagtagtattccatggtacacatatatatgtatatacacacaccatggaatactacatctatatatatatatctcttcatatatatccatatatatatggaatactatatatatatatatatataaaatttctttattcagtcatccattgagatggacacataggttgatttcatatctttgttattgtgaattttaaaactgaggcacaatgagactaagtagcttgccctagaccacacaccctagaagggacagagccagcgttcaaacccaggcagctgagttccggagtccatggtacgcataaccaccatgctgtgttgcctgcctagttggtttgtcaacagcttgtttattgggtatttgctctgagtctcacattgtgctgagctctgtgacaaaaaaaattttaagcttagtagggagtgtttgtccttaagaaactgacaacctcactaagtacataggagtcctcaagcacagagttttagtagggctgttgattgctctgcggttaatccaacagttctggtcatgacattgcccctggattggtgccaacctccaactctagagcaggcccagcaattggaaggtgcctgcaaaatcattatcgagcaagtgaaacacaaaggtggagaaatgtacaagggacgcagaaacttgtctttgtatcagaaagtgggtctagaactttagagatgccacatctgtggcaccataaaccatacagatggcagttctatttcctgaagaaagtggcctcgaggcagttcatctacctcaacagggcaaaaagactggtcagcaacatctaagacaaagacagatgttcatcaaactttaggacttattttctctggacatggttaaccataaaagctaagtggatttcaggactgtcaacaatctcccaattgataggctctaaaattggcatctgtgttctttaaaaattttattcatctattcatttattcactcatgtatttatttaacaaatactaattgcattcagtgttctgcactaaatgcaggtctgtctccaaaacttaaacttctactcaatatgactgtaactggaaagaggacactccatgtatgccatgtccaggcaaaagaggggtcaccttcaacctcttgtccaatgatgaaggttatggggcagcagggtactccccaaccagagtacagcagggcctactgtagtgctctgaaatgtacagagaaattagaaactggtctttgtatttgcaggtatctttatgggtctcccaggtcagccttccataaggtcttctccgtacctgggacttcaattccaagcccaggaatgttggcatagagaagcaatgtgggatgcttctcaattttctttttctaattgttactaatggaagaagtcaacaattgaattgttttcttcctttttcttctctgggtgtcccatagggtcttgtacagtgttcttcatataatcatggctcaagaaagactttttggtggttgatgctccccataaacctggaaactccttctctacctgtttttgggtgcataaggataagcaatgcccatccaatctttgctcccagtgccactggctccaaggcaagcctatgtaggcacctcacaagtaactataaaaatagctagcatttagtgacttactacacactttatgtgcaatatctcatttaacctttgccacttctctgggaataactgatgctgttctcattttgcccatgagaaaatcaagacttggagaggatgtttattaatattgtgctgtttgcaagctttgacaacagactcttcacagtgcttttctcctgttatccagggataccatcgacctcggcactacattgcgactcaaggtaagtgccctccctccacctagtgcctcagagaggcttcaggggtcccaggggaaagggctctcttaactgcaaggcttgtcctctcctcctatatctgttactccaaccctcctttttcactaaacagccctggaggagaggaatgagtttccaccagcaaagaagccacggaggggtaggctgaagactctccagaggtccttgagattgttcatttgtttatttgggaaggaaaatggtggcaagtttcactataggaaaaaggcccatgagtgacagagcaaggagcttcacttggtcaggagggagaggcccaagcaggtgccatcaacacctgccagggccggagctgatggtgccttatctccacgataggtgcatgcccataacagatatgcagctggctgccctagaaagtaacttggcagtgcgttttcagaaggcttaaaaatgatcgtacctttcaaacccttctggaaaaaaatcctgcagataattatatatatagacaatgacgcatataagaacattattcacggtgttatctataataggaataaaaaagcgaaaaatcttaaatgcccaacaattggtacgttggttacataaagtgtgttaccgccatattatagaaaacttcgcagctattaaaactgttacgcttggtaagaatttttaagggcatcagaaaatgcatataataggtctgatgcttattacagtaaatacacacatatacatataaatatagaaaaatggtattcaaacttttatatcaaacacatgtattacttttgtaattttaaaaatgatgaaggcccaggacattgaaagagtaatttccaaggaaattgctttggactgtcagagcctattttctgctcctggtcttttttttttttttttttttttttttttccttcctttctgttgaggccctagaggaatgcctccagcatttgtcaagcacaaaatcaggcatctcctgtttttgttctcagcgtctggcaccctgcagctctctccaccccccaccccagttgccttcctgtctctcatggaggttctggagaccaattttcgaaaactcccttaagccataatacagtccagataaggtgataggtggagttggtagaaagggtctgagcaggaggaggacagaagggagaggagaggctgccaacatttccagtagatgctgcagattgtgagagcttggaatgagcctttccccatccataccctaatctgtccccatcaggctcacatgtctcaggcccgtgtctcagatacttggtgtcttaacaaggatcacctggcctcactcctgctcaccagtgtggagacttgaccaaccggggggacaaaccttctcagctgctgctttgcacttgcattctctaacctcactgtcttctctgttggcaggtccgatgcaggagactgtaaaggacttttggagaatgatctggcaggagaactccgccagcatcgtcatggtcacaaacctggtggaagtgggcagggtaagcctctcctgcactcgcctgggcagaggatgctggagatgcactctcgaacatctctttgttccatgcatcgtgctaagtgcctcctagtcagtatttcaccctcacggcaacctacaagggaggtgtcatcactcctattccacattcaagcaatgtcctttcccttcaaatccccttcatccctttttacaccctcactctccgttgatgatgtcatctcatatattttgaggaaattaaaaccatcagtcgttcactccctcattgtcacaccacaatcctacttgtatctacaactgtcctcttgttcttctcctctgctgtcagatttgactataagaaatggctgtttttgttgacccaaatggtcgaatgtcaactgtttcctatggctcagcctaacacaacagaagccatgtctctgcccttccaaaggcaagcatagtgcctggatcacagattctactcaataatttttttcatttttccctttctcacttgcaaaataagtctctttctcattgccaaattgttccccttagcatacaaacatgcccagtaccttccatcttaaaaagaaaggaaaaggtaaataaaaagtattttcttgttccctcttttctgccaaactttaaagactcacagggtggctctgtttcttcactcatgttctcttctacccaccgcagcgtagctcctccctccatcccaccaatagtgatattgtcaatatcactcgcacccttcatgtcgacaaatccagtctccacttctctcttctcatcttactcaatctcagcagcatccaaccctttgctacccgctcttcttcccctgacctctaaatcttgatgttcttcagggctcagatcttggtctcctgctctgctccatctcaactctctctgaagtggtcctcaactactcctggggcttagaaatgggactgctattcccagcttgcttttgcctacttagttaactctggcatgtgggtgggctgctgagtttaaaggcaaggtgtacaaacacgagaattaaaagggctctctacacatcatatgaactaactaaaatgtgggcaggtaagtttttgtttgggtaagaaacagataattcataaagatgaattctggcctctgcgacgatgggaaggagacaatctgggctttcgtaatccaataaaggggtatggacatctcagggcctaatgggaatttaggaccaggtgagactttacccatgagtccacccttatctagtccatcactcaattttacagatgaggaaacagacctaaaggggtagagtacctaccctgacgtcactcagccaaaacctaggcacaaaatctgacgctggactctgattccagtgcttgtggtcactccactcagactgttccccagggacccaggcccagggtgcagctactgtggacataaaggccagcccaggattcagggattcagaggcaaattccagcctgttctacaatatatcccccattggaaacagattcccttgatggatagaccataaatctaaattggatttggggaggaaagcagtctcttagataagctcctgctagtgccaaacactgtgccaggtgcttattgtgcattaccgaaacctacaaccatcataggagcccatgttcctagttattattcaagtgccctgggtttgcatcctggccccatcccttaccaacagttgaccttgggcaattttcttagctttcctatgcttcctcgtctgcaaaatggggatgataatatctacttcataaagttgtgttgataagtcattagaattaatacatgtaaagtattcgcagaacactttgtgagccgtggtagacagagtacacagtcagtaaatgttagctatcattattgataggaagctgaggctcagagaggcttcagcactttcttgggccacccagatactgagtgttaggaccaaacaatgaatccatttgcccccatgctctgttgcactataccagtgtttccctaagtgggttccatgggatgctagtctgcaggatgattagtgagaagagggttccacggttaaatacgtttgggaaatgctgcgtcctctgtgccccttttggagagtcgcaaaacacaaaacacattagcactagcatgagaaagaagctgaatagtcctgtagcaaagctgcctatttaactgtgtaatacagcatttcccaaactcatttgaccacaaaacctttttttgtttgttttttgtttcttgttttttacctaacacctattagcacccagcggaacacactgtgggaaatgccactctaggccgtgcggcgtcccccggaatggtaatcatgcttttgttcttttaaggggaaaaccatgatctctttttcatccatgagtgcgacttaaacagtcgactggggaatggcttgctcgcgtccagggtcagagaggaactgcgcatcttcccttggagtccagcagctaccatccttttcccaaccaagagcctttctccttccagacccccaactgccacctcttaatgatgtccccctcccaaccacttctgcttccacctcctatttcccaccttttattctcatctttgctcagctgatgatactcagctgctccaccctgacagagcagaaaggggactcagtcagtccccaaactggccacatggccttggacaagtcaccaaacctctgaacttcagtattattttcatctgtaaagtggggacaataacacccacctatctcaccttgttctatttgatgacatagtgtgataatgcattggaaagttacaaggagctttgcaaaagaaggtactacaattatttctaatggctccagtgcctctgggagtgagcttggccctgtgcagcttgctgatccctggccagctgtgaaccctgtggactgaaatgccaccaaagtcacccttgggtttatttggatgggacgaccagatgagacagctgctcacactcagccatgtgcttatgcatccttgtctctgttctgtctctgtctctgtctctcacttggccacaggtgaaatgtgtgcgatactggccagatgacacggaggtctacggagacattaaagtcaccctgattgaaacagagcccctggcagaatacgtcatacgcaccttcacagtccagaaggtaagcttcttggaggctgtgggcagccggtccaccatgagagccagcttgtttgttcatccagaacatgtggtaactgagggtctgctctacgtccagccccatacttggcaccagcaacagatcagcaatcagggcagacatgggtcctgctaccagggatcccacatctagtaggtggggcaaactgaattcaataagcaaatcaatgaaataacaacacattgtgataaaagccacacaggaatatgcaaaggatggagatagaaatccacagtaggatggggtggtaggagagggcctcttagcagaggaggcatttgggcagagaatgagggaggaggaaccagtgaagggtagaaaggaaagaagagctatcccaggcagaaggaaaaaacatgcagtctggaggggaaaaagtgatctcaacctgttcaaggcatgtggtctcaaccgggggcattttgatcccccaaggaatatttgtaaatgtctggcaacatttttggttgacacaacttgggggagaagggttaggatggtactggcacctagtgggtggagaggccagagatgcttataaacattccacaatgcacaggacagcctccgacaacaaaggattatccagcccaaggcatcagtagtgtcgaggttgagaaatgctggtctggacattaaaaggaggccagggctgcacaagcttggtgagcaaggatgtgattgcaaataaatatatttataacatgttacataataattgctattctatcattactattatatcataatgatagctaacacttactgagcacttactggaccaggtacttttctaaatgctttgcgtagagtaactcagttaatcctcccaataaccctataaggtaagcactattattatccccattttacatatgaagaaactgagacacagagagtttaaatcagtcatccaaagttgcccagctgcaaggttggtacaaccaggattcacaccttggctcctgtaacacatttctctttccattacaccataggttccatttctctaaaaccaatcactttaatagacaatgtggccacaggcctaaggatgcaaaagcactggggacttacatgctttgagagctgtgcccttgaggctttgacaagtccttgcaagggccaaagcaggctgctctgcagactagagcccggcatgcacacagtactgttccagcatacagagtggcctaggacatactgtttgccccggaagctccccctccaacccccaggctcctaaagtctcagggtctttttcatctgaatctgcagtctcgggtgaaaaagtcaggaagcctgtgaactccctccactaagaggaaggaaaccatcggtacttcaatgttgccttaggtcaggttttttagaagcagagcctgaggcaaggattcagaaacatgaggtatatcaggggagctctcccaggagaaattcctaagagagagtgggaagcaggagagggaaggaaagacaccaaccaaggacagaggctccagtgaagtctagcctagagctgatccacagggaacctccaaggataaactatgccacagagtgagttgtcccccttaaggcgtggaagccagacttctgtgctcccacgtcagtcagtctgctgatcgtggaccatccactgaggggtaacctccagggtgggccagcccctgtcagctgagggcgtgtctccagagaaggggacaattgaaaggcagtagcaaccaacagtccctgcagctcaggcctggaagcacaggcccaaggaagaggacccaggggtaccagtctcatctgccacatctgtgttgaatgcccgaggatgggatgagtgactggcgacacgggcagggaggccttgaggaattgcagctagcaaaccatgttgaggcattaaggtcctttctcgtgttacattttctttgtcttttaaacaaccacgagggaagatattactcacagggagatgcccttaaaagaccccaagggcctctgaggattaactgggcttagccagcctctccacagcatgcaggcaggcactcagcaaacattacctgcgattttagctcaaaatcggttcctgagctgggaacctggaaataataaacagggagtgctgtctgcccttgaagacagcacagacgcatcggggagagaggatccttgataaatcatcacagcacaggtgggaagagctcgaaggaaggcttcttgggactgaattgatttggaggatggcgtgaaaaaagtccaagtattcttgaagctttctcctctctcacttcagctcattcatcactgccttcatctgggcatctgatttctccctcctaacaggactgtctgcctctagtcctgcccctatgttagtttgggtttcccagaagcagagccagaagcagcagtcgtttgggtgccctggctcatgtgtttagggagagtttgcagggggaaggcagtgagagagccaggatggggtggggaaaggagctgagtgaggaagtggcctcagcagagacttgcttccacctaaccccatgggagccctggaacatgaatggtactgcacacttggtccaaccttgaggcaaaggggcctcaggtgccccccataagggtaaaaaaaatttctgtttttcccagaacattactggttttagcactgaaagtcccacgtaccgggcaacccgtcagtcctgggcagactgagcaagtggcaagccagttggtcactctccctctactatcagtcagtcactgaaggatgctgccccacccagccacaccccaggggaggggggttcctgttcagctgagaacagttctcttcagaagagggtaactgtgagctgtgtgcagccacgactcagagcaggtggcaatgagtccactggcccagtgatggggatctgagtgggcaccaatagtgccctctctgcaacccccgatccacccacctgaatccatccttcatgtagcaggatgcagcctcctaaaatgcaagtctaatgatgcacttcctcttgtgtggaaccgtctgtgtaatctccctgtagcttcccagtgcctttgagataaagtccaaaggccttaatgtagattcaaggccttctgggatccagctctcatctattctcctgcacccccaggcctgtggtctcccatggcctgacttccacttgcctctagcattgccctgggttgctagtgattctctgcacacaccatgctaagccctgtccccaggcctgtgcccatgctgtccccctgccttggattccttcctcttctcccgtcaactgggtaatactcacacatcactatattagaatgattaagagtgcagactgtggagacagacagccagggttcacatggtccctttacaacttgtgagttgtactgtgaccttgggtgtgtcacttaaccttgtttagcctcagtttcctgatccatcaaatggagataaaaatatagggatttatatcaggattaagtaagttagcatgttgaagtgttcagaagagtgactggcacacagtaaatgcttagttaatgtttgttagttattattttcactattagtctgtttcaagatggaggtcaagcatcacctcctccagaaagccttctgggatttctcttctcctcagatcaggttagcaggcactcctttatccacttcaatagaattacccacttgggcatctgcctccccgacaaggccatgagctgttccagggataggagctgtggcttttattctcaccttcctagtacctagcacaaggctgggaaggctgggcacaggtcacacttggtaaatgatttttcaatgaaggaatgaatgaataatcaaacagactcttcctattcagtgttctctgggtatctgcaggagattgctaagtagaaaaatagtagggaacaggaactgtctaagcgaaggcttagaagtgtgacctggccatggaatggtcagaaaaccactactgggcccggagtgtgtctctgtgaggggtggaggggtgtgaaaggggaggggaaccgctcagagctctaggccccactctgtctccatcagatcagagaagctctgcctttgtttgtttcgcatcttatgtaatcattctaagtaagaatctacttaataaagaagtcagtactaagttatataaactttgaaagccacacagactatcacagccaaggctggaacactacagaatatcagacctcaatcactgaacgcctcagattccactggaaacaatttggactgacttggtccttaaggccaacatttctttaaatccgtactcaatacacctcctatgaaacatttgtcaaagacgatcccctaggcaaacaaaagaaggtctcctagggtgctctgtggccctcttgggcattcagagtgtgtatgagcacactcaagactctgagaaatcctgcaataaagccatcggtttcgttttaacaatcccatatttcccaaatgtaactgattacagaatcgctctatccagtaacacctattaacaaacactgtgagggccctgtccctgcgggaggttcctcagtgcagcagctatggctccacgtgttgctgggctgggtatgcgagggcagcagctggaagaacagaggcccgttctttcctcagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcaggtaagtcaaaggtccttcaccttgggaggccgaggcgggcagatcacgaggtcaggagttcgagaccagcctggccaacgtggtgaaacctcgtctctactaaagaaagatacaaaaacttagctggtcatggtggcatacatctgtaatcccagctacctgggaggctgaggcagaggaatcgcttgaacccaggagcgggaggttgcagtgagccaagatcgcgccactgcactccagcctgggtgacagagcgagactctgtctcaaaaaaaaaaaaaaagaaaaagtcctccacctaccctagtgtgcctctgcagctcggctttcttgggagggacatgttatcttttctagtggctttactcttagagactcctcttcctgtgtcccccccatgcccagtgctttctgatgatacttggtcacaaggtcagctaacaaaaggaatagcagtagtggccattgttactgttgttgcctgaaaacagtgaagaagtcagtcaccagggaggcaggctgaacactggcagcatctgctgggtctgtcacgtgcattttacccacattatttacttctcgtccagtctggagaggtgggcattattaacattcccattttacagatacaaaaactcaagtgctgaggaggtaaacacagagtggggatatttcacctgcttttctccagacacttgccctcagctccttgacatggcagcagggcgccttggtggaagcatgcttcttttcatttctatattattttcaagatcacttgccagcctgcagggtccctcatagagagaaatggacagcaccaggttttaccttattatgaagaagagatattttcagctctgacctagaaagtcacattgagaatgagtggcatgtctttgaatcctcccaaatggagatgaagtatcctgtcaagggtgtccagaattggaggaggatggccttcctgacctgaaggctggccagctggcatccccctccttcccaacgcctctctcttccaatatgaccttggggcagcccatcttttcagaccctggatgcttgagttatcacatccctgccctggcagtttgtgtcagtcaagagaccatggaagactccataagctgtggatgtctcagagccagccccgtcctcatacagcatccatttatttatcttcccagcaatagtagctacacaaccccatttcacagataaggcaagtgaggatgaggaggtaatcctggactctctaaatgttttgcatgtattttctgctttgctttatatctcatagcaatcaaagggcaatggatcattaatgccccccatctctatatcccaaagagcacccagatcaagggttagggagaaagaaagaaagacaatggcaaatgtttgtttatcatcaggacttcggcgcatgatggctctacgccggtatgtgtctccttagcaggtcatcttaatgcatctgagcagagtggtacccactcctggggccattctgaaaattattaccaaatgggttggctaagtgcctaagagagaatgcctgacatatagtaagcactctaatatatcattattctctgcctcctcttaatgttttctttctccccctccccagattatttattaatccttcaggacaggaacaatgtttgtttgttttcatattcccactcctaataccagcatctactgcatcttagattttcaataaatatttgttgaatataatagtaataatttctcaataaaaaatggctatgtatccaggcacaaagcaatttgtatgcattatgcattttaattgtaatttcatccaatttatacatattgtgctattaatgctgtgaggtggatctattaattattatcaacatcattttatagatgagtgagtattttaattattatcaacatcattttatagatgagtattgaaacccagagaggttaagtcatttgcccgaggtcatgcagctaataagtaatagagccaggatttaatcctagggggtcttttcaaatatcctgtgttcaattactatgtgatgctgaaatgaaataaacacagctttgtcctcacaaggaccctgcagggaggtatgttaaaagcatcagaaatctgaagctaacaaacaaacggacactaggcaacttggtcaccgctgattgattgatagttgttccaaaatttggaaccaaattgggctgattctttatactaaagcatggtgaatatgaacattgaagaaaaaaacacgagtgaccccccctatactccctcccagacacagaggccaagtctcttgagtccccgcatctggattttggggagtaggttctgaagcaaacttaagtcagacttcattcaaaccatgaaagtttctcatgaatgaagactctgcttccaatgggtgtactttccaaattgttgtaggtagtggtccgcactggcctgtgccccttggatttaccatgagccaatattgcttttttgtcttgttccatctctcttcctctttgtgtgtcttttgacatctacattgttagacaaagacacttgtttccatgagaaaggcaagatgtgaaaacgcagcggaagggggcctccttgacaggctgcccggccttcccatccaaaactgcacatgtgtaaggcacatgtcttacgtgcctcttggtcagcactgatgtttcagagcccagcactgatctagaaagggctggccaaggcccatagagtctcgttgagttcccctaccattttatacttggtctgagattctcctaaagaagccactagtgaccagaaatcaagtaagtatgtatcaagaaacttgatccctgacaagggtctccggacggtcagctgctccagtttcatgacactcttgcttcacgatcctgcgaaaacagctgcaggtggagccagatgccggcctttgaacgtggtgctccaccaaccactctctgtcttggggacagctcagaggactctcgtttctgtcctgtcattcatctcccctctgttctctctcctctccttctttgcttccatccgtcaacccatttgctgaagaagaaaaaagaagagaaaagaagggtagaaaataggaaagacatatctatgaggcagctccagcatgccaggaaccatgctaggtgttttatgctatatggatgtattattttatccatcagacaaggcaatggcatgtatatgtgtggtttgcacatgcattacaaactatacatattaagaaaggaaatgtgggaacacataatctagagcctcccagcaggacccttggggatagggctgaatgctaggggcctccccagggcaggttccccccatgaagatccttaacacagaccatacctctcttccagtgctggggctgggcggactggctgcttcattgccattgacaccatgcttgacatggccgagaatgaaggggtggtggacatcttcaactgcgtgcgtgagctccgggcccaaagggtcaacctggtacagacagaggtgagtcctagggggccaagacagttggccacctgtagccctgaccaaggagaaacatgatgatagaacggagagacacataggtaggggcatcctatggaaaggacctgggtgtgagagaagcaggagggagtagacacgtggcttactatggtgagactactgtagaagctagggtgccccagccaaccctggaggtctacagtgcaggcagttccaccaatgaagaatggtggtgagttctccatctctgaggccatccaagcagggacagaatgacaaatttcggggattattggaatagtattcttgccttgggtgaagtgatagagaaggaaagagaaggactggcatttattcagtgaccactacgtgccaagcgatggttcagtcactgcagggaatggtttaatcaacaaagtaattgagtacttaagctgggtgctgggcatttcaagagatgtaacacacagcctctgccctcaagggagaagcagacctttaggcaactctctgtgcagttggagagcccaaacctaagagtattgaaaggaattaatctttattgttgtgtacctactgtgagccaggcagcatacattctttctagtcacggtattgtttctactcctccaaaccagctatggtgtagctcctagtattatctccaatttatcaatgaagaagaaactaagaaattgtgtccctaagacctcacataccagactgtggtagaacttcggtccatgtgacccccaaaggcctctgctttttcgccagaaccacactctcactaagcagccttttctgcctatcccactctgtaccttggcttatcattcctgtaacgagcccatcttctgttctagtgaaggctctgggtgcctgggcgaccagagctgggacagatagggaactatgcacatcatcaatcctgcaaagggaagtgacccatggttttggtacagccagcctctctgaatctgcagtgaataccaccattgattggtttacacacataggctctgagctaactcacacaggccagtcttcaggcttctagcactaaagccaagagggctgctttatctattcctaggtccatgcatgcagaagccaggcttgctggttgcagtcagacatatggggagacatattcaaatgcagatgcatcacatagcatctggaaaagtactctttatagagaaactgaccaagttctgcagaaaaagtcactcaacaaacatttatctggggcctagaagtaacaccaacttctgcctggtggattaacagatggctttccagaaagaatgaaacattaaaggtatggaaaagagggagtggagtttcaggaggagagtacagcaggtacaaagaattgagataggagaagatatgacacgttttgggagcagatcgtgagacaaagatttgccggcaaataatttgcttggaaggtaatcccaagacacagtggctggtgaatgggaaagtgaggcagagcagggaaggaaacaaacaaaggctactttaacaagttgttaaacactgtagacaactggaacccaattctgctggcgaactctgagacacatgcgtgtccaagtgattccacctaaagggagagatttcttagatttctatcctcaactctccatctgtcattgcttgagggttcctttccacacagcccaagtatcccctctgccttcagcagacaatcacaggtgtttgcagcaagcagccttcctcaggtaaaggtgaaagctgaggggacatgggctggacaccaagagcgcctgctgacagcatgtctagaagtttctcattttatcatgactatgctattacatcttctatcagaaacaagacccaccatagctcaggtgatcattaggaaacatggaaatttggccctttgggttacagtataaaaagtaaggatcctgtaatatattgataaatcatgtctattcttcatagccacaacactaaatgtggacagctaattcccaggccactgttcttacctggcaccccattccctctcttctgactttgcaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcaggtatgagcaaatcccaggctcggtgaccatcttagtcagtttgggttgttataacaaatttccatagattgggtggtttaaatgacagacacttattcattacatttctggaggctgagaagcccagcatcaagcttccagtaaatccagtgtctggggagggctcacttcctgacttgcagatagccgtcttctcgttgcatattcacgtggtggaaagtagaagcagcaagctctcacatttcttcttttttttactttttatagagataggatctcactatgttgcccaggatggtcttcaactcctgggctcaaggaatcctcccaccttggtctcccaaattgctgggattacaggcaggagccaccacacctggccctacatgtttcttcttataagagcactaatcccgttcatgagggttctatgctcatgatcgaaacgtcttccaaagtcccaacctcctaataccatcacattgggggctaagattacgacatggattttgggagggatgaaaacatttagtccgtaacagtaacccaaccaacttcagtggctatgtgcacatttgtggggttttctttgggacaactgatctatgcactttcagtgtctgcttctctaggaagctgcagaatctattccagaacacaaaatgcacagccatgagcaactacacactcactcagggattgctggtacttgtctttaactgtgaatatgttttttaactgaggtcttattcagttctagtccaagttgtgaatggagacaaatttatacaaacaggtgtgaatttcatgctccttcatccctggagggactcaggtcctctcagtaatttttcagtagactcttactgctaaaagtgtggtctgcagcctgaccaacatggtgaaaccctgtctctactaaaaatacaaaacaagtgagccaggcatggtggcatgcacctgtaatcccagctactcaggaggctgaggcaggagacttgcttgaacctgggaggcggaggttgcagtgagccgagattgtgccactgcactccagcctgggcaacagagtgagactccatctcaaaaacataaaaaataaaataaataaaattttaaaacctgcagtctggagaccagcagcattggcttcacctgggaacttgttataaatgcagaatctcggacctggcccagacatagtgaatgagagcctgcaagttaacaagatctctgagtgatttgtatgcatgttaaactttgagaagtactgtcctagaacatagctcaggtataccagatccacacctggaagcccatgcggtcagagctgtggcaacattgattggtctagggagcctggacatgaatcactaagtaagataaagccagagtccagccctttatcccaagaccagtgtcagaattacacctgggcaacaggagctgagaaccaggtatgagaaagcaaggaagctccaggtcttgcttcaagtcagtgggcaaatgccaggcccattgttccacgggcagatatcccaggcaggccaataccttagcaatccctaaaacaaatagccattattgatctgaagtagagacagagagctgaatgagggaaggatggagggtacagaacactggtcattgcacgtaacatctagtccattggctagagcagttcagctctggcctcaaacttgcaagatgtactcggcaaagtccaaacacagcaatttcccagacctgttagggtttgcccctcggaggtctctcatctatcctgagcaggtcatctaggcatccttccatactcagacagctttctctctgagaagagggctggtaaatcatttcccccattccatgacaacgcaagtgatgtttagccctcagtagggattccctacccccacccctctgtatgccctcctggctggcccaccctttaaagcagcactggctgagctgaacgacttagttcatctggttggcaggtactatgaggctgtgtctgagcctgtgtgtggatgcgctgcttctgcagccttggcgttttgaaggtgtcacacagctcacacaccctatagcagggagcaggagaggacagaacatcaccgtggaagagaaatgggtcccgggaaagggagagtggggctgcgcttagagggtggaaataggcgagttaggctgagttggaacattactgtctcttttgctcaggggcagccaaatgagcagggcctatctattcacctttgtgccccacagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatgtaagccgagcccgggcagaaagctcctagctggcattctagggcaaatattcttcctgaggtggaggtggctggacctcagggccctgaccccaccagccagccccccctgcttctgatctactagtcccaaggacctttgttcccctgcaggctctggtccaaacctagacacaaggtgggctcttggctccttttctcatacaaagagcctggaaagaatagaccagaagcgtaaggtggctcccgtgtcaccatggcaagtctacaggcctgcctagcaacctcttccattccccacagagccgactctcagcctgaagtttagtaaagcaggtattttctgtgctgggccttggcctgagcgtgggaacacaagacggtgcagacacaggttctgccctctggtagctcccatgaaggttccagataactcctgagcagagacaaaaatgaggatggcgcacagtaggggctcagtaaatggttattgggaaagtagtgggaagcagtaaaacaagcatggggtggaagcgggctgtgttcctggctgtcctgtgagggccactgccccccactttcttgtcatcaggtccaggaaggggcttcaccctaccctggtttgggattagggtcatgttcctggtccagcgagcctaagcttctcccctgcgtttttcggatacttctgattatcatcacttcccctccaaggtgtacaggtgtttgcagtaggaaggaactatggaccatctactaccagccatgcacttttcagcagagaaaacagaggccagacagagaaagagacttgctcaaggtcacccagggagctagtggcacagcccacacacagagctcctgggtcacactctggaattcatttcttgagcctccctgcaatttggtggatccaataagaggcaaacatctcacctcctgaggctcaaaaccaagaacaccattgcctgatataatgagcccttccagcttcccctccccagcccatctgagttcacatccatctagcccatgtggccctcctatctcactcagaatagacagaaacatgggatgctttctcctggggtcaaggccaacaacttctctgacctctaatcctcttgaagtttctcccaagggtctgggtgttagaggcaggagggtgatgatggaaggtcaatgcctatcccagctctctaggggcctgccctggcctctgtccacagagtgcccatatcctctgtaaaaaccctagctctgggttcagaatcagggagtcttggcttggtcatagcaagtagctagaggtggagagaagacctttggcattagcttatagcttagagccttctaaagtcaatgagcgcatgtatgtgtatgtgtgcatgtaggtgtgcattatgtgtgtgagtgtgatgagaaatggagcctaggggtgcgcccatacttccaatttcctcctagctttgtctcccacttctcccaacaccccctccctgccttcctcatccaggcaaagatcaaataagctcctggcctctacttaataggttagatactgcctggagtcaaatgccttctgccaagctctgatgctgattgtattctctttgtccacagggcatttctcctgtgagccatcactggggcctttgcctttctgatattaaaaacaaaaaaaagtcgtccttatctgtattccagcccagtcagtgcattatctggtaaccatagcagctttgctcctagcagaaaaatatgaagtcctctgggttaatttttaatgtttcccctggtaaaggatgatgttatccatgaaatggattgccggctgatccctgaaacccggcaggagcacggatctcgaacatattttcagataaggctttgtcaggcgtgctggcctaatagagcgtttatcacagagacagggaaaaagaaaagaaaactaacattcactgagtgttgggcaccatgtcgggccctggacttgcactgtcccattttgcatgtgggtattctcatccccattttctgatgaggtcctcggggtcagagtattttcattcatcacttgctcaaggtcaagtagctcagaaatgggagccaaggattggagccccaagtctgttaactctcaaagcctcaatgtttttccatgtctggaaatggctcaaagttgatgctgtctacagctagagagtttggcttttggaaaataaattatttgcctatgcccacccagacccctcttctgaacattctactggccaggaaaaggccctcggaagaagggcccccccagccaatgcacgcatgatatccatgtttgcaaggctttgtcctgctttttccagggtctttgccctcttccctcttgcttgtaactgcactgaaaacagctgtaactcccacagaaaccatcatcatctcttgagaaaacatatcaagcacatgagccactgatgaagtggagaatcttcccaatcttttcaaatacatgacttcagggtggggagaaaataaatagggccctggatgaagctgccagaccaccccaccccccccccccccgcccaggccattttctctgggcctctgtttccctatctgcaacacgggactgaatttattgttttattcactggagtggcactgtctagcatgtgccagcgacaataccagtgccaaggacgtaaaacaaagtcaggggtgtttctgccctgccagtaggcttacgttccggctcttgtttgctggccttttcacacgtaaatctcattcaatctgtgtgacatcattcctttggatttatgatttccgttttccaggtgaagaacatgagctttggaatcatctaataacttgccagtatttagcacccaccccgccaaaaaaaaagcactctacaaagtttgaatgaatggatgaatggatgaatgaataaatgggcaaatggatggacagatggatgactcataacttacaagtggtaaagctgtacttgaaccccaggtctaccggactattaataatgcatgtgtactttccactgccccattgactcacatgacacagtgcccaccttgccagggcaactcagcccctcactccagcctggaggcagaagggagcctgcccctttgggagaatctcggcctcaggccgacccaaaacctcgcccagcatcgtggccacagggatgcggccaatcccttatatcccaagaggtgtcttgaccagtagagcaacaaatctgcatctgaaatctttcatttcgtattgtaattatgattatttgctgagctccgaggcataaataatttatttggataatcccatcccagtgacactttcctaatgaaatgtcttagtttggaggagattgtgttcattatgagaaggtcccctttgccgccagggcgtggagagataaaagaacaggcaggtgttttgtataatctatttggcaggctctggagcctctggcctcagtccaggcctcatcatcatcagaatatcactgatggatgtgtaatttacgaagcctgtgtcattcctttgtcagagccacaagcagcctgccgccttcgtggtcacccagcaccctctacccaacaccgtggcagacttctggaggctggtgttcgattacaactgctcctctgtggtgatgctgaatgagatggacactgcccaggtaggaggaggccaagccaagccctaggtgggtcaggggggccatgctctaaacctggagggagatcccttgacagccggtgcctgccacatctgccccagccagctgtcttgtaataagcagtgtctggccacgagcatcagacaagccattctgctacctacagagggtcctgtcaccccccagacctccagcaaagactccccctgcctatgggctttgtccaactccccacccgggaccagactctgttgctccatctcacaagcattgattattgtcttgctccaaatcacacagatcttgcagagccaggaggcttcctcccccagcactgagcacctgcagccctgaaaaatacccagatgcccggccacactcacctcccttccccctctgcaatgcagcctgtacagacagagcctgggacttgaaccttggacacattacccactgaccaccccaccaagccccagttcctcacggttgacctttgttccccggcaggcttcctgccttagcccctctgttctgatagctccaagcatcacgtgcctacagcatatccccatactcaggacacaggacgtgtatcttggaacagtttctatgccagggcagccattctggggtggaagagctgagaatggtccttcagatttttaaaaacctatcctttcactgccttaaataaaacttaaagtaacattgaattcccatatgagagctggccttgtgcaggccttggatgggaatttaaaaattttttaaacagacctgagctatagtttcagccctccaaaagcgcatggtcttgctccagagacagatgagcacattgtcccaacctcatgtggctgtgttataatagaggtcagcagtgaagtgctgtgttggccaggagcagggagcaatgaattctgcccagagggtgagggaagacttcaaaaagaaggtgactttggccttgaagaaggcagaggagctttaggcatatggaggctgaactcactgggaaaaggcatttcaggcagagggaacagcagaggcaaaggcgaggcaggggatgaatatacacagacttatttgcggaacagtttatgttccagtgtggctgggacctagaggaatatcaggaggagaagaatgtagtgaggctgaaaaatgcagcagagcccagcttgcagagaggtccctgtgccaggctaaggagcttgggtcttggttggcagcatagcaagcttcagacttctactttgtaagcgacagaatcctttctatgaataaaagctttcatgcaagcccaatgtatgaaatagggatgaccaaaagctgctcatgatgaagcagtaggcaggggttgggcttccacccacactgctgtctcattttctcctggtgcccttagaggggtcagtcctttgtgggaccactggagtttggaggagcacagttagaaatactttctgtgcaggaaggtgaaacactggagggttgacagtggtataacacagccagggttcctgttagaaagatgggtctagaggctgggcatggtggctcatgcctgtaatcccagcactttgggaggccaagagttcaagcccagcctgggcaacaccatgagaccctgtctctacaaaaaaaaaaaaaaaaaaaaaaaattttaattagccaggcatggtgccatgtgtctatagtcccagttactcaggaggctgaggcgggaggattgcttgagcactgcaaggctcaagtgagctatgatcccaccactgcattccagcctgggtgacagtgcaagaacccattttttttttactgactcttactgtgtcatcccgactggagtaacagtggtgcgatcttggctgactgcaacctccgcctcccaggttcaagtgattctcatgcctcagcctcccatgtagctgggattacaggcgtgtgccaacatgcccgactaatttttgtatttttagtagagatggggtttcaccatattggccaggctggtctcaaactcttgacctcaagtgttccccctgcctcggcctcctgaagtgctgggattacaggcgtgagcaaccacatctggctgaccccatctcttaaaaaataaaaaaaataaaaattgcaaaaaaagggtaagaataaaaagaaagccaggtctggggatcagtgcaggtaaaaggccggaggaaagacctggaaaccaggagaccggggaggagaatgttgcaaatgtgtagacaataaaggtagttatctgaactgcagaagtggccaggaggtgagaggactggaattggacgtgaaaacatttccagacttaagtccccaaggtttagggagcaggtgcaggtgggaggtgaataagaaggaaagttgcagataatggcaggaagttgagtctgggcaattaggcaactggggatataactggggaaaatatgaaagtcaggaaggtaggggaaggcagcgagaagagcagatgaacaggggatgaaattgagtgcaccttgggatgtgcctgtgagagacgttccggagagagtctattgattcaggcaacccatatttgttgggcatctgctatttgctggaagctattctaggtgcttggaatgcatcactgagcaacacagacaaagcgaggcataaaaaaaaattgccatctctcatgcaacttctcttctaaagcaggagacagataataagcaacacacattctctaatgtgctcaattataagttagaaggctgacacgagtgtttggaaaaaggcaaacaagaaggcagggtagtaaagatcagaacgttggatctgggacatagaatgtcattgcaataggattgtcaaggtgggccctatggagaagaacacatttgaacacagacgtgaaggaggtgagagagtgagccatgtgactctcaggggggcatcacaggcagagggaacacctgcacccaggctgcagggtaggcatgcacctggtgcccttgaggaacagcacagaggccatgggcagagcagcacaactgtggggaaagcagcagaaggtgaggtcagagggccatggaagacatagaagaacttgggctttcactctcagagaaacagagagccatgcacatgtttgaagcagaggagcaacataatttgccttttttaataaaagcatccctctggctgctgtgttgagaatagattgttggtgcaaggatggggaagagtggtttctgaaatggaagcagagagaacagacaagagactactgtgataattcaggtggcaggtgaggttggttgaactggggggtagattctgaaggtaaagccaacaacacatccagagagattgactatggaataagagagagaaagaggaatcaagggccaggcatgcctgtaatcttacctagcactttgagaagccaaggaagcaggatcacttgaggtcaggagttgaggccacgagttaaagaccatcctggacaacacagtgacaccctgtctctacaaaagaatttttattttgagatggagtctcactctgtcgcccaggctggagtgcagtggcgcgatctcaactctgccgcctcctgggttcaagcgattctcctgcctcagcctcccaagtagctgggattacaggggtgagccaccacagccagctaatttttgtatgtttagtagagatggggtttcccaatgttggccagactggtcttgatctcctgatctcaggtgatctgctgatcttggcctcccaaagtgctggggttataggcatgagccactgcacccagtcctacaaaataattttaaatgaactgggcatggtggtccatgcctgtaatcctagctacttgggaggctgaggcaggaggatcacttgagcccaggagatcaaagctgtggagaactgtgatcacaccacagtactctagcctagggcgacagagtaagaccctgtcaaaaaaagaaagaggaatgaaggataatgtcaatgattggggcctgagcaatagaaggttagaaactgagataactataaaaataaatgaattctcataaaacagagagttctggaacattccctgcagagttttggagtctgaaggcatcaccaccctacgcttttggctgaagaaataaaagaatgaactcagctcatgagcctgggcatgaagtctggcctgcaaaaccctgtttgctcttctctttttcaacatccctttctgcaaaaccagagctcaggcacagaggatgactttcaaagaacttcacttcgggacatataaaacctttgaaacaaaggtcaaggtcattggctatagctccccctttcagggtgggtcctgggtgaatgaagaatctttcaggcccagatgttggtacagagtttgagaactgattctctaaatgcaaaaacatcaggctcagaagtaccctgaggttggctgccatacgcagctggcaagcattccctgaaaccggcagatgaatagagcacttattgatataaatatcatcaccgcagcagctgggcgccttatgaaaataaacaatgacacaggatgagcatcagaaaagccgccctcagcacctggaggggcggttctttgaagcggcgtcagcatctgtctgcctgcgtgctcatgccaaggcagcctccaagctagcccagcctggcaacatggacaggtctgccttaggacctgagcattgctaggtcactcctgagaggaccgatgccatctcctgtggtttgcctgggaaccataagagcgtacgttggggattgggcagggctacctgtaagctgcagcaaaataagaagagggtgtaagctctcacagggccttattttttttgcactgctggccaaatctgcccctgctcagaatcttacactacttcatttagtcagccccaaattttctttcattcctgcagtggttgctgttcaaaggtaattatgatcaatgagggctcaaaataaaggcattcaaacttttgcattcaaccttacagatttttctaactctttaggactccaaatgtctgtggtcagatttgtggggtaaaatcctagaaccacgccagccagcaaagcatgctgtcacttctcagactcagcagaaagaacattttcaaccacatccaacagcattgacaagatcttttccatctttgtggtctctacggaccaccagaaagacaccagaaagaagccctccttgcagtcatgccacactcaccatactgtttagagagctcaggagatcctgcacgccagccaaagggtggggctgtgtggtagccagaatcgtggccccaccagagatgtccacatcctaacccctgagacctatgaatgtgctatggcacctggtgtatggagcatacaaggatgtttctttcctttaaaacaaataagagtccacaacttacataaaagctgagttgctctgttctggggctcccactgtggaaagcctgagagatcagggatgcaaagccttttggaaaggtgagggtgcctgagtgcaaggataatgggggctgtgatggattcccatggaagtgagagaggcaagctcctcattctcccaggagaaaagcagggtgctatttcagagatgtctcttgctgccattgtgcctctagggcaaatagcaactcctaatatccccatttttagtctgggcttgtgaaaacacagcctaacacaccagcaaaatatgcaaaatacccaacctgcatctcagccagcctcaggtctgactttgcaaggggctgtgtctctgtttctgtccccaccagaatggtaggggtaacagtaaaaaagaaacctggggtcaagagacctgagttcaaattgtagccttggtacttactcactgtgttgccctgagccagttcctttactttctccaagtcttaatgttatcatttgttagattactataacctagatgttagccaagttcattctgtctttgaagatttaaataaaatttgctctgttccctactccccatcctatgggaaaacccaatgtccatccccaacatttctgagaattctgagggggttgtcttctcatgtttacttccaagtttcagctgaggctttagtcggagagatatgagcttcatatcccagcaatgcccatgacttcaagttgaacatcacacatcctctttctgaagcctcaccttgcctcctcagctctcactagcagtaacacatcttcccctgaccctgttgcccaaaccattttcttcccatttacctcctttcccatccctcccttctcagctcttccaccctctccccaaaagttgttcctttcttaagctgcaaaatctagccatctccttagtacgtctttcttaaacctgctctgagccttgcctcccaccccaagactcttctgtaggtaagttcctaaactccaacccttccttccctgaaacaaactctgatgcagctgttttaagagtaagtttccacccactatgtggagattgtattatggagcttcatgggactactggaaggatacaatgaggagagatgtgtgaatctctctctctctcccccctctctctccctctctttctccctctgtccctgtcttctttatgccttcattcacagtctgccttccttaactggacatagtatcaaagccaattatatatttttggatctttatagaatctgtttaaaggaattttataatcactgatgctgaattttaaaagcaattcaggaaacttacatttctctctttaaaataccaattcacttcacctttaggtggcctgggattgatttcttcactctgggtcgcaggggccttaataaataaagtcctttatttctaacgtgatgatattacttggcctttccattttatcaaagtatttttaataaaagaaaggcataactaaggtgcactgaaatatgctctaaaaatgtttattccaaaaatagacccatatgctagttttcattcaactcatcggagcatgtttattccagtgataacaagctttctgattccatcagcaagaaaaagacgtttaatgcgtgaggctacctctgcatttgttatatatcacacgtgaacttgcaccccccaaggacatcttttcatggcccaaacagccatggagagcactaggtggaataatgtatggcagctgttccagggctatccacacaggcttcacaacctttgcttggtttaacttgttctgacaaaagacaacaaaagtcccctctgtttttttggaagaagcatgattatttctaaatcattaacaacaactggactgacttcctctccccggtgtgttcatcgccactacctgtatgtatctgcagtggcaaagccctcccttcaggcagtatcacctttcaccctcagaccactggaaaagaaagggtaggagagagtacttactaggcaatgaagtggaaaaagtcagttggtctagactcttggctgaagaatttgaatctattcttggatcagccaacttcaaaagttttacatctaaggaagaaaatgtcaaggttgcattcagggtaagtgtggcctttaggtcagctacgtcctcgtgatcttaaagaggcaagtaggcttcctagaattcccatttcctgagccttaagaaaccataagctttccctccccaggagttgtataaatcgcagatgcttacgtgcttatatgaaaagtctggctcctccactcacagatgtgatctctgttccatgtctatgtgagccagggagccgagctcagtttcttgctggtttctgcaagaaatacatgcacagtatgcattttacatgctattatgagtttatggcatatttcagagtttaggagcagggttatgtgacacactgagttgccttttatacctcactgcttctacagtgatctcaaccttcctcttttatcttctgggtcattcagctcatcggagcaacccacagatctctgtattttgacatgcagtatcccatatctaggatgctactcatcttcacagctaccccaagctggctgatccagaatttccacacgggcagtcctttgagtattatcctaaagagaaattttcataaaagctactaagtggaggaaaaaaatcatctatttatccatcttggtttgaggaaccctcccccatactgcctaataatcacagcttacattaattgagtacttgctagatacagatccctatgctaagtagacattaaaattcacagccactcataacaaactggagaagctaagagatgtagccaagccattcaaactagaaagtgatagagccacgatttgaatccagggagcttcaagaagaaaccccaatgcattttcgcaccttttgctacacaacataagcaaaccaaaatggtagcatccattcaggtgcagctacagcacttgaacaccaggacagtcttgagctaaaccacagaggatgtttcttattgatgagagtcatttctgagccccaaagggtcagtgggaagagaaaacatggcccccctgctttctttctcttatttcccatggctagaatatatgcagtgtcccgggctgcagagagaccctgatgatccctggcagctcaaacaccacatttgccagcacatcaccctgctgaattcacccattctgctgctgctgtagtctcacaaattagggcatccaagtgaaaggatgactctgatttaggattagaaaagcctgcaaccttccccagccctctgggcattatgagagagtgacccagaaaatcgaatgcagagaagtgtcccgaaatataggagtcttgtttgaggcgtagtagaatctatcagcttgagaaattggtctggaaatcttattaaaagagacaaatcattccacattctctccagactgaagatattggggataataggacttccctgataccttggatccatgcaccttgtgtcaggatcacagccaaactctaggaaccctaaattcagtgcaggtgataaaggcaattattttttttaatgggcagttctgattaattctggtttctctgaccaaccatagacttatttgtaccaatctctcattactgtgaaggttgcaaggcggaagagccaatggcaaagagaaatgaagttcaaattgtggatttgtcatcattgcacagctcagcagatggttgtccagccatggaggcccgtgaccagcgcccgacaagacacacacacacacacacacactcacacacactcagagctcctttctcactatgcttggttaacccccagtggagacgccaggaaagcaaggcatcattgcgttctgaagcttaaccttgcatacttatgctatttatgaggggcgataagaagaatccttcaaatttatatatcatagctattactattattatttttgttgagcactgatggattcaacaatggtatgaatcactggaatttagtaaatgcttattccatgcctggcactgtggtaagggtttatttacatgaattatgtcctttatcctcagaacaaccctataaagtaggggttgccaaactttttctgtaaagagccagataggaaatatttcaggttttgcaggctatatggtctttgttacaactacccaactctgtgggtgatgcatgaaagcaactgtggacaatacataaatgaataagtgtagctgtgtttcagcaaagctttatatgcaaaaataggcagctggctgggttggcttgtgggcaatagtatgccaactgctgctataaggtgaatattcctaagctagaacttggggtttccacagctaagaaggtgggagacatgagtttccatctcctacatccttcctgctcgctgctcttcccttctaattctagttctggaggaaggagagaatgaaggtattttcacatgtgacttctcagggtgagatggctgttcttcggccacgaagtggagagcaagcacccccttcgatgaaaaccctgcatctgtagggggtgggtcacttctgtccatctagccccctatttgcaagcctggggtagcctgaaccagacccccgctgaggagagactcaatcccaaactgctctcagaagcctcggtgggtctttctttgtgaatcttggctatatcttcagggtaacccccagatgaagggtctaacacatgacttctttgttcatgttggggtggtccccagcgagcctgcagccgcaatcttgtctcccctctgtaccccagcaatgggacctgtagacctaggcaggatccatcttgtgccccttgggaaccaggaactggagggagcatgccttgctcctctctgcagccacacaccccaccccccacctcaacattctctcctcagctaaagttatctagtggcttaacagagacaaagatacaagaaacaagatatccatctcttcttcttcttctatttttttttttttttttttttttgaaatggagtcttgctctgtttcccaggttggagtacagtggcgtgatctccacccactacaacctctgccccctgggttcaagtgattctcctgcctcagcctcctgagtagctgggattacaggtgcccaccaccatacccggctaatttttgtatttttagtggagacgggtttcaccatcttggccaagctggtctcgaactcctgacctcacgatccacccaccttggcctcccaaagtgctgggattacaggcgtaagccaccgcacccagcctccatctcttcttctcaatgacccctgaagcttaaagaataatttatggccaggtgcagtggctcacacctgtaatcccggcactttgggaggccaaggtgggtggatcacgaggtcaggagatcaagaccatcctggctaacacggtgaggctctgtctctactaaaaacacaaaataaaaataaaaaaaataaaatagccgggtgtgatggcacatgcctgtagtcacaactacttgggaggctgaggcaggagaaccacttgaacccgggaggcagaggttgcagcaagccaagatcgcaccactgcactcccgcctaggtaacagagtgagactccgtctcaaaaataataataataataattataatgattttatactaggttttctcagtctctgcactatggatatttggggccacataactctcggggggagctaatctgtgcactgcaggatgttgagtagcatcctctcctctactcactaaatgcccatagcaacccgcaggtgtgacaatcaaaatgtcttcagacattgcccagatgccctctgggaaacaaaacagtctcagactgagaaccactgtcttaaacagaaggtcaatcactgccttttgctctcagctgtaggttctaatttccaattccagataaatagaaagaatcataggcaagatctgtcagcaccatgtgacattaacttttggtgcaaagtaagcataattatccccactttacctatgagaaaactgaggcctgggctgcacagctagtgagcacctgagaccagatttggacccaaggccgcctgaggtcaaacccatatatatatatatatatattttttttttttttttgagatggagtctcgctgtgtcacccaggctggagtgcagtggcgcgatctcagctcactgcaagctccgcctcccgaaacccctatattttttacactacttctgatctgatcatgaatgaacactatgaaggttttcctggaatgaggaagagcttgtgatgatttgcgtggtgaaaagaaaactagatggtacttgccctttctttagcatgttctatctaatcctgacagcggggcttagaggtagatattattctccccattttacagatgaggaaactcaggttaagcaaacctaacaaatggtttgaaatcaacatagcaaagatttgcaagcccagtgtttctgtgctcaaagccttgatatttcaacaccagaaaaagtggatggctgctccctaaaggggaaactgagtctaatttcctacataatactctacctttctggccaatgtgtccttccagccataaaaaaagcttggtgacggctgggcacagtggctcacacctataatcctagcactctgggaggctgggacaggtggatcacccgaggtcaggagttcaagactagcctggccaacacggcgaaaccccatctttactaaaaatagccagacatggtggcaggtgcctataatcccagctacttgggaggctgaggcaggagaatcacttgaacctgggaggcagaggttgcagtgagccaaaatcgtgccaatgcactccaggctgggcaacaagagtgatgctccatctcaaaaaaaaaaaagaaaaagaaaaaaagaaaagaaaagcttgttgataaatgagactttgatacccgccccctgcctttgacctccttctgtgacctctttccttatctcagttctgtatgcagtactggcctgagaagacctccgggtgctatgggcccatccaggtggagttcgtctccgcagacatcgacgaggacatcatccacagaatattccgcatctgtaacatggcccgggtaagtacacggccgccattgcttgctgagcccctcctccccaagacagatggaggctgccgagagaggatcccgctgagccagccaagagtctgtgttgtgctctcctgataatttcttccttgaggaagtgatgcctgtgctgattccggctccagactcagcaatgactccaacacatagagatgcaacgagcgacatccaacctgccatctgcctgtttcctgacacacttgctgccgtgtagacaaaacttcttagacattagctcttccccactgtgtctctgtactggcatgagttgatgcagcctttgattggatcccataagctttgggccaggcactgccaacacctagatgaaaagtgattacttacttccatgaggatgttcactggctgagcagagtagtgggtgggaggggcagattagcaatctatgaaatggttgctaactaatgcagctttggtcactacttggggcccaggatgaaaggagctcagcacctcccctacccccctgctcagagttcactgtccactgagacagtgagacatgttctggcacatgagcctcagggagaaaaaactctgcccaacagagtcagggaaggctttcctaaagaaagggacatttaaattgggttttgaaggctgagcaggagtttttcaggtacaaaagggggttcagggcagtcacggcaagagaatctgtgtacacgaaggaatagaagtagtcatggggactctccccgtgaggacatggcttagatcccatttggtctgtcttccaccatgatgctgcagtccccggggtatctgcaaggtgcatgtacgcaagcatccccagcagaacagccctaacagcctctctgttctcagccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctgtgagtactagggaggtgtcaccagggcaatagggtggtgggtgatagagcatccttgcagatgctgctggccacataccccagtcctaggcaggcctggctataccacaactcaacatccctcaaaggctagtggcagtacattcaaaggaattatgatcctttaatggaacggggctgccagtttgttgtcctgaactaatatatgacatattattgatgcaaaacctagtggtctttccacaaacatgagaggaggttgcctgcttctctacaatgggcttaaagggatcataggacaaaaagagcatgagggaaaggcactgccctcaggggctgatagatggatgtgaaggactctaggaacactattgtgcaggggcacagtgagctccagaccagctgtgtttatacccccattgctggggtgaactggagactttacctcctgtcttcgaatggacattgtccagtctaatgaattctggtgtcattacgctgggtggaggtcaggacctcgagaggacagtggctgacaagctgtgcaacgtcaagaaaatcactgaattttataagcctgagtttcctcgtctgttcattgggtatgtggaattagacaatcttcagaccttatagtgctttggcatgaaatagaaagtgaacacactttatctgccaacatagagaccaagaatgtcatggtagcaaatatgcaaacgtaaatgtaattacttaaaagagcaagtgtcacagaatctatcctgggagtatagagtgaccacagaggattctacaaagtctcacacccaaaacaaatctgcagccataacagctatgtgtgaaatatttgattcacactcactttgcttcttagaacttcaacgatttgaggaaaagtcattgagaaggcctctctcttttaaaatgttatgttaaaggaaatttgaacgaaggtcttctctttcttacaacaaatatttctggagctagtggaggcactgataacatctgactgacctcagaattgaggtcagtcttttcaaaaccagctaattattctccctctcaaacaggtggtgcatgcacatgttaggcaagtcaaagagcttaaaggaggttaaacacacagacacatagagatgcacacacagagcttcagggccaccacctgcagcaaaaattcttctccagaggaagcaaacctcaggctagagttcaggaagatgctgcgtagtgtcccaagtcaggctgatgggtgacatcagccaagcccagctggctctgcccacatcccagaaactagcagctggtttcctgccagctaatagctgctgcctccagatgcccagatgcctcccacacattcaggtgaccttaccttagcacccatctttcagggtctcacaccaccaggccctgagaccctgtgtctactcacctcttccttttggacgctgttattcttgcttcagaaatgatagaaccgtctttcataggagacctttctctcctctctctctctctcatgtttgttttttagcctgcttttttttttttttttttttgcactagtgtctttttatctatgtcctttccagccaaggtggccagtagtttgagccaaaggaaggtacaggggcattcttttaccaacagggaacttggtttccttgagggccacagacaccataacagaccttgaaatgcaggcaccagtcagtgaatggaaagcaactctctgtacttgaaacatctggtcactgcatgtcctgtagataaaacatctgggagattgactgagtgccttagtttctgtccagatgttctttagacacagaccattacatgaaatcattagttgctcttggcaacacgcccaggagttctgaatcaggcatattcctacagggactgtctgtaaagagtttgaagggtgtttccatgaagatgatttatggagtttcagaaaggagtaacagagacacagttctgccaccaaccctgtatccctagactcaagatcagtagcatcttgcttaaaccaaagtgtatagtagagacctgtcattttaagataaagcctatcaggcccagttcctccctccaagttcctacctccaagcttgggctggctgaccctaggctaacagagcattgctgtccttagtggaggatgggaagaactagtaggaaaatcacttggaaattttcattgtctttattggatgtttaagtggacccagagcattcttttggacatggatgcaagcatcagcaaggatgcaggtgtcacatgtacaaagacacagtaccatcctgcccttggggtttgggtgagtgtgccctgagtgactgtaacatgctcatagaaccaagaaaacatcaagctaattgaactctcaaaggtcatctagtccaaccccttcattatacaagtggggaacttggggcccagacagaggaagtgacttggccaaggtcaaagcaagttaatggcacagatgggactcaaaccataactcatggctcaggctaaagccttcaccattgccttgccttgcatctgcccagacagctgatccctactcctactgatgtagctttagaatcatcaggtgcctggaagggacctaggaacatggctcacctctttgctctgtgtttagaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggtgagtatcccaaggactgttctccaacagccagggctgactagttcccttgacctggagaaaatgacatcaaatagtaacatcactcaacacctggctgctaattgtatacctgcattctgtgcccttggtatgcactgttgtctgtcctgtgtcttccccttccaacctccccaacttttctttcttgcaggaaaatccaattactaatcctggtacacctactttgcttcactttctgcccattccttaagacagtgtcattaattcaggcctaaaggaaaggatgctggattagtagaatgtgaagtatgttttcaattcagtccaattatattccaattaatttatggtaatttttacaatagagagcatttatagtagagagtactatggaggaaagtgtgataaagagagtgtgtgggcagagccccgggtgataagacctggtaccatggtggaccaccgcaccatgcacgaggagctttaatataagtctttaaacctactcgaatagtggtcttagtcaaaatgaggccatattaacgtgtgggtcacagaccagcagcagcatcattatctgggagcttgttagaaatgcagaatcttgagccccactccagatttactgaatcagaatgtgcattttaaaaagatttctggctgccttgtatgcacgttacagtttgagaagccctgttgtacaaaacagtaaaaaagaaagggaatgatgccagctgggcattcgaggaagcttgggtagaagcaggcatcaagcagaattttgaaggatgtccagatatgggtaattttgagttgacataatatggatatagaaaaagttttctccaaaatctgtatctctaaactaaatgcattttccctttcctttttcatctctctcgtctcctcttctccctctctgcctctgctcctctccgcctctcaggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaagtgtgacttcagggagaaacaaacttgcaaaaaaaaaaaaaaaatctcaggccatgttggggtaacccagcaagggccagtgatgatttcccccagctcatccccttattttcccacaacccaaccattctctaaagcagggcagtgaataggtcttaggccagtgcacacaggaagaaattgaggcttatggatggggatgacttccctaagatcccatgggacaaggatgtggcaaggcttggatgagatggggcaccggtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaggctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaatatggctgtgttaaaaaatctatacaataaagctgtgaccctgagattcatgttttcctaagata

SEQ ID NO: 129 - DNA, 12466 bp, Homo sapiens
atgtatttacccatatctcttttgtctacaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaagcaccaatgggcagcgcccaggtgaccccggggactccactctgcctcctcaccacaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgtcccaaaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaagtgtgacttcagggagaaacaaacttgcaaaaaaaaaaaaaaaatctcaggccatgttggggtaacccagcaagggccagtgatgatttcccccagctcatccccttattttcccacaacccaaccattctctaaagcagggcagtgaataggtcttaggccagtgcacacaggaagaaattgaggcttatggatggggatgacttccctaagatcccatgggacaaggatgtggcaaggcttggatgagatggggcaccggtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaggctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaatatggctgtgttaaaaaatctatacaataaagctgtgaccctgagattcatgttttcctaagata

SEQ ID NO: 130 - protein, 1444 aa, Homo sapiens
MYLPISLLSTGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKAPMGSAQVTPGTPLCLLTTGASTQNSNTVEPEKQVDNTVKMAGVIAGLLMFIIILLGVMLTIKRRRNAYSYSYYLSQRKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 131 - DNA, 11319 bp, Mus musculus
agtgcccacctcgagcttccggcaggaggctcccggcgagagcctgggcggaggtaagtgggcgtgtgggcggtcccctgccttctcgcccggcctcagtttccccagctttccagtggctctgggcccgttcgcctggcattcgccgagcacgtacgaggggccgggtcttggggatggggggaaccaggtggatactgccgagcaggcgcggcagggacacgtgagcaaacacagtcgtcacgcggtgttaagtgccacgcgcaatgggggtcctggggaaggggaccagagcagagagcatcaggttgccttgccgaggaggacgccggctgatgttccgggcacacggctgtacgtggcgttgcagctggcaggcaggatccagggagaacttgcggacccagccccggggtctccggtctgttgggaccggcagtcttagtttctttccctgatgcaacttaaggaaggaaggaagaaagaaagaaagaaagagcttatttcccccatagttcttggtgctgtccgtcgtgaggaagtcagggcagtaagtgcttgaagcagctggccacgtcgtttccacagttctgaagtatagaatcttgagagccatcagtgcctgctagtgcactctcccttctttatggaggccaggagttcctgcccacagctacctgggtctcctcacatcggttaacctgatcaagagaatcaatcccttcctggtatgctccgaggcccgtctcccaggtgaccctagcttctgtcaggttgaccacactaaccattccaccagtctctggctccttgtggactgcaggcaagtgcaggcagtaggtgaacggaaactgtggtgtagtgtgtggtggtgggagaggaagtgaagagaagtgggtgggtcaaggaataactagaggtggacttgacaaggcaggagatgagggatgccgagggaggcagcaatggcttcactggtgctgactgccttctgccaaagaaaacagttgttcggttggccgtttctaagtgacttgagagtcagatgaagacccgaggaatattaaggtagctccttgcagcaccttgaggttgagctgtcggctggagttacggggttggtcgtggtgggctgggaatgaaggcggcaaagagaggctgggctgcagccctcaggcatctgtgcttactgaatgagtcagaaagaaggaagactccagagactgtggcaagttgcacccgctaggtctctgaggaggaagctgtcagtttcgtgagcagagccacagaaacccgggctctggcgaggtgacagggaaagagtaactgcctgggtgaacagcctgacagactgaggtaagggagtggggcctgacatttggaaactttgctgtaggtgacagaatgactcctgccattcgccagtgccaagtgctgctcctcgtgccagtgatccctctgccccccaaaccacacggccagagaaactgagtcagataactcagagtctcagttgtaggggacgcagacggcttttctcacagatctctgctgtgctctgaggcactaagctggacacccacgttccagctgaggaggtagagggcagccaggtgctacagtgtcgccccaccctgcgctgagggagccactgtttcttggggaaagggacacttactaaattccttgcttgggtagatgtgattagaagcctgctctccattaccatggagggagggtaaggcccttaggaattttacatctgtatagccagtgtgaggcaaaccgctgtttagtggggacacagagtggctatctgcttccaaggtcctttctggttctgtctgtgtggggggataggtgactttctgcatggtgccccatagaggtggggagctagacaggctctgaaggaaaggggagacttgagcagtggacaaatggcagtatggtgaccaaggaggaagtgcgccgaagtaggcaggttagtacgttgagagaaaagagaacaggatgccccatatagcatgccccgtgactgcctgggaaggggcggggcagcggttctcagggaggactgcacgggctgctctggagtgtcggagactcaacccagaccctccacatgctgtgccagcactacaaagggatttttggacacagtctgggttgttacaacttgggtttggggacatgatgcttgtggcatctggtgggtagaaacagggatttgttaacagattgcagcctataagattggccttgtcgggcaatcttagagtggtggcacacgcctttaatcccagcacctgggaggcagaagcaggcagatctctgagttcaaggccagcctggtctacagagcaagttccaggacagccagggctatacagagaaaccctgtcttgaaagacaaaacaaaacaaacaaacaaacaaaaaagactggcctcttccagaaagattcagtagtgccaggctgcagagtcctagagaataagagaatgtgggtctggaggtttgtttgaagaacgtttgaccctgggtccccaactgtttagcaatatccacaggagcctgagattagtggcccaggtgaacaggtctagtcagcagctagatctgcctctagagttcatggtgaccagagccggctgcatgctgggcaggtgtcagtgtgcagaaagcaggtcaaggtcaaggtaccaggctgccttaggcaagtggggcagggcctccctgatggtcccaccgtgcctttagtcacagcctgtttattaacctggacatcagtggtgtccaaacagtaatgggaaaggattgctggtgaaataagctgtttccctcttgtctatttctgtggtgctggagtcacagtgagaccactggtgagttcctcgtgctgcagaatgcacaagagtgagcccaccatgaggggaagcacacagcccccaggcccgcagctccagggccgtgagcactgttgcaaagcgggttttccagactgggaactcttccacttgggcagcacatgtggtattcttaacggtttcagtgtatggcagagccctggaaaacaacggttgctgaaaccagtggccggccctgtgcctttgtaactttcagattccgaatgcagaatccttcttagcctttatagtccctgctcactaaacgctgggcgcctcctccaggtcaccactcagggttctaaggtcctctaaagatagccacagtccaggagtcctttgggcaaagcccacagccagcccagtttaccctcagggaggagatgtgataacaggttccagagtgcagagtggtctgtccagcctgatcggggaagaggccaagctcagggttctggaaggttcccagagagctggcatctcagcttggtggggaggaagcacctgtagtacccccgaagaagcagatgtctaacagtgggccagggcccacccatgcagagccaggcttgccctgggcactcagtggtgttgctgggctgactgacaagaggtagtctggtttggcaagcaccccctctctgggagtagccgttggagaccagggcaaggtatggctgatccacctgaggtcctaaagacctgaaatcccatacatgctctctgtcagagagtcatcagactaaacgggaacatagagaaggccaggtgtgcatgcagccctcttggagtgcaaccttataagcattacactaggggacggggtgtggctcacagggatcatggccccaagcctcaggccctgggttctgaccacagcactaaaaagaaaaaaggtctatctactcaaatcacaccccttgagattgctaccaaaaaaaggctctggaggaagagaatttgtactgaagtggccgcattgacagggatggaaaggtgggttgggtgtggtgttccctccgtcccttctgggaacaaactggcagagacagactagaccagattagaccttggacctccaggcagggctttggccttgaaggccagctgggagctgctaaaggtctggagcaagctgactgatgagacctcagtcagctgttgaaaggtcccatgtagtgggaacacgtggaagacagtttgaatgtacactagagcctcaagtacctacctggatgggggtgggactcatgatctctgcagtctcatggcaaccagagctggtctgtagccacaccaccagaccctgcctctcttctctccagcagtagcgctggggacctgtgaccgctgcatccagctaaccatgggacagtttggctctggccaccagccccttaggtgaggactccatcaagggcccactgcccattccccatcatggaggccgagaggatccttccagccaggggagctgccctttgaaaaccgtggtcgagtcctgctggttctccctgccagccaccttcaagagaggctcctgttcctgctggcccacggatggggaggtgggccctggacgtcgcctttgtgtggaaggcagctctgaccctgggcctggtccttctatactactgcttctccataggcatcacgttctacaacaaatggctgacaaaggtaaccagaccttgccagtgcagggaccggcactaaggtggctgtagttggtacagctgtattgggtgatggtggcttttcctggacgctggtcccgggcgggataaacaggtggctagcaggggtggcggtgatgaaattggacaggaagtgagtccctgggctgccacttctctgtgtgacctccacagtggggaccagccacttgttccaaggggtcatgcagggcacaggattggcccctgccaccatagggaggagatagaggggaatgtggcatctctccactcctgctgtcgtctttgggcttcacagagcttccactttccgctcttcatgaccatgctgcacctggccgtcatcttcctcttctccgccctgtccagggcactggttcaatgctccagccacaaggcccgggtggtgctgagctggacggactacctcagaagagtggcccccacaggtaggtccagtgtggggagggctgctggagagcctaggatagaaagcagaggcccttgtggccacacgctacctacctcctctcctccccacctctctcccacggccaggtctcagcaaagccggcagttgcccttgtctggcagttgcccttgtccgtgctggctcacatgggcctcaagcgggctccaccagacgcagaatgggggagcctcaccctgtaaccatgctaagttgggctaaaagatttcctaggactagtgttgagtgggcaggacttgaagagtggatggggacctctgaccctggggatgtgaggtcggaaagggagctgagagctcggctggagggggaaaggaagaaggagggttagcaggctgggccagtggagggccaggtgcccctcgagccatttggcaggatcgggttaatcctcttgcatggaactgtttagattctctcgcagaggagactaacaggcctagccagtcaggatgggctccagcgctaagcaggacagcctttggctaggggttggccttgaattgcttagtggaagggaagacaaacagggccttaggtgtctaagccttatgcttgccaactggctgccctgcctgggtgtccctgtccccacagcactggcaacagcacttgacgtgggcctgtccaactggagcttcctctacatcactgtgtccctgtgagtactgaccacaccctctgcccccttcaggccaagcttactcgctccttccagctggcaggctgcacagccagcagtggaccagctcctccgccacccccagggaccagcccccccccccctctctctctctctctctctctctctctctctctctctctctctctctctctctctctcggcccctcccgagcacctggcagcactccaggcagctctgctaagcccagtgcagagagataggctgcacctgctggccaggcagcaaggggaagccaagggattggacagagatgctgcaagttcttggcagggtgggtgggggatggggatgggaggaggcaggcagcaggtaggaggaccaggcaggggagcgggtgagggtcagagatcacctgtctgcagtcacagccctgatgtctcacgtcagagagtgcagcccctcacttctccttgtccaggtttctctcattcttacctggtctctaccaccaaccaggtaaagaacagaccgagtcagcttggtgttaaacccccagttcaccctccagtaacagtcagggctcttagagacttcttcccacaaaaggtgacatatccacgcagaccccactggctggctccttccagtctcggagacctggttgccctcgggtgggcctgccgccatgcattgtgggtatctgctctgccccaggtacacgatgaccaaatcctctgctgtgctctttatcctgattttctctctcatcttcaagctggaggaactggtgagccccacgccccttgtcactctgtggcaggagactttctcggggaggagacgtagatgtgggtaatgactgaaggtttagaaacgggtttggcagcggggtctgcgtggtcccagggcctgggattcccctggggcaactcggcggctcctgtgtgtttgggggcctggaatgggcaccagtccttgagtgttttgtaacaagtgtgacattaggacatgccagctgcatgccagccacgagtcctgtggaggcgctgaggcatggaaggaaggctggtgatgcccagtctacgggtggcacatgcttgagcctggagctcccagtgagctgtactgtcccccctgtagcgtgcagccctggtcctggtggtcctgctcattgctgggggcctcttcatgtttacctataagtccacgcagttcaatgtggagggctttgccttggtgctgggggcttcgttcatcggtggcatccgctggacccttacacaaatactcctgcagaaagccgatcttggtgagcctctggggaggacttggggccgggtaaacacaaagcaacaggctcagcctgacaaaacttgccatgtcctgtcctgcaggcctccagaatcccattgacaccatgttccacctgcagccactcatgtttctgggcctcttccctctctttgccatattcgaaggtacgctcggtcttctccctctgggtgccatagaacagcagatccagcattgccactctgagctcagcacggtgctagccacagaggttgccctgtggtttgggaataggcagacacacagaatgactagcatctcgtgagacgaggatgcagaggaattaggagtaaaatgcaaggactcagggcagagggcgaggacagccccagaggcaccttttaaatgcacaggtctgtcatatccccttacaaccagatgtggagggctgttgtcatccctgttcagcaggagaaagaaaccgaggaaacgggacgttcaaagcttgcccacagtcccatagctcataagcaagccagactatgtccccacaacctggcatcaggaggctaggcccactgtcacactgtgcacttgcctcctagagtgcagagcccatgtctgtcacaggtggggtgtctgggctggagggggccatagtagagcatgattggtgggcgggtgaactgatgacgtctggataccctggcaagcagggcaagaggctcggccatggatgttagtccgcatgggcagagtggtcccttccacagctggggttcgggggcagcctgggtacatggacaactgttctatctcccatagctttcagaggagaggcaaagccagggggtgtacaaggtggacagaatgttgtcacctgtcttcctccagtgctttgggattagtctttgtcacttgtttaccctccttctcagagtcccaactgtcctcagggtcattacagaaaattccatcccacatccatttaagtttcaagcagcgaagcgtctccagcctccgtgaggaaattattccgcagccccgttgtccaggaaacttgtgtgtggagccttcatgcttttcctttttaaaatctctccccattccttcattatgccccttgtagcaaacaccacactcgccccctcccaggccctctcactgttcccgctctgcaaacctcatccgcaagcccctggtcgccgccacttagcagagcagcatggacttagctcctttaatcttctctggtaaattaatcccccaagcgccttcattacttatgttgctcttccccgaattcccttcaatttgcctttgcagcgctctgagcccggcaccaaacaagatggctcacacggccaggctgctggcctagggcatgctgctgtggaattttgcacccctccccctctgagccccccaaagttctcctctgccttcagtgctctcctgtgtccactgcgcccagtggatagtgacctcaccctcccctaacacaccctgaggccttactgtgggaagagcccaggagccctttaagaaggaggggcccctctcctgaaaatcgaagcaaaaattggtgtgatatgcagcgtgctctggaacaaggggctgtagtctcatcgtagtttacatatgtatgatttgggtcttgtgtagcccaggctggacttgagctttctgggtagctgatgcttgagccagtcctctgtccccctgcctcaggtgctgtgattacagctgtgcactgccacccctcagctcggggcttaaggtggagggtagtttttgagataagttcattaggtcactgcttgctgaagaagtgacagtctagtcactgtcctgtcattctgtcaatagggaaacccacagccaaagggggccatctccaccacagtccatacatagctttatagtagcaagacccagatgtgggctgggctgtatagatgggtggtagagcataaggctctgtgtgtgtgtgtgtgtgtgtgtgtgtgtgtgtgtgtgtatacacgtgtacatgtatactgacatgcacgtcatctaacatgcatgtcatctaaaggtgagggccctacatctgtacattttgtatctgtatacagtcagcctccaccagagtccacaggtacaattcctcctgttctgataatggacacgcattgccctgggctctgtagtagccaccttggtccctgagtctcaggccatctgtgggggactatttcaaagccccccttctttctcctacctcagataatcagctagccgcactccccaccccgcgataccatgctgaagaaacatggtagctgttgagtagggccaggagggctgcgcaggccccagcctcccactctccccttgctgctttcaggtctccacttgtccacctctgagaagatcttccgcttccaggacacagggctgctcctgtgggtgcttgggagcctcctcctcggtgggattctggccttcggtttgggcttctccgagttcctcctggtctccagaacgtcaagcctcacactctccatcgctggcatctttaaggtacacactgggcagccaccccagacctgccctggaaggagccccctgagggatgcaggatgtgatgtcattgtcccctgtggagctgagccagtgtcacttctcaccagcacgtagctctgaggacgcaggccaggcctcacaccgccaggcctgcagtgggcctaccttgggcctgactggcagcttgagttacatggcagtagcctggagcactgaatgctgatctgtgcagagtcccagcactgagggctgggtgcacaggtcatgtctatggaggagcctggtcaggtagaccccatgccggagcagtgacacccaaagcaaacatttgggtgttaagcatcttctagctctgatgaggagagacctgtcttaacgccatgctgagagctgtccatctgtgggtgcctagcaacagccgactcccttactgttgggggcacgtgtgccgcagtctgggggttggttggcattcagtttttgctgagaggcatgcatctcagtaacaacaggtctgcaggctggtggtctgggtacagaggtccccacctctgcctgtcacaccaagtggtctggctttggcctcagtgtacacagagccccgccttcctggccacagagtcagcttctgacccatggtctgcctttacccacaggaagtctgcaccctgctgttggcagctcacctgctgggcgaccagatcagcctcctgaactggctgggctttgccctctgcctctctggcatctccctgcatgtggccctcaaggctctacattccagaggtactgtggcctcctccccatggcttagtgttactgactgcccctcccaccatctagccaccaattgccagctgttgctgtagctcatgtgccaggtggtgctaccaccctgggaggatataagggccatccccagagaagtttactaggtcagtaactgtgacgtgtctaccccaaggtgatggtggccccaagcccctgaagagcctgggctccagcgctgacctggaactgctgctccggagtagccagcaggaggaagaggacggggaagaggaatattttgtgacccagggacaacagtgaccagcccaggagcagcaaagcaggccactctgtggtcatccctgctggcagatcttggccaggtccagcagcccagccggtttctcagagccgctgcaagtggtggcctcagagcttcctgcaaggactctgagcctccggctcttccctgtggagcttggtcccaaaaagcgaatgccaggctcacataggacctgagctgtcagtgaagggagccagtggcctgtctccaccattgttctggttctgagagccaaggtgaacgtgagagatgaggtagtctctcagattcggactgtggggtatcaggaaaggagtcatggagagactaggcctcatcacctggactgcagcttcctcagagagtagatttatttatagttgaaataatgatttcctctccacagcccagtgttgcctaaggcatgagagcagggagagccctggggcctggcctctcctccgttccctgcctggggccttgtcctccgctccgccttctgtagcccatgctcctgtttgtgccccaggccccatccttggggccacaccatggacccaccgcaggaaataaatgagtgtttgctcagtaccagcctctggagactaccagtgcctcagccc

SEQ ID NO: 132 - DNA, 2003 bp, Mus musculus
agtgcccacctcgagcttccggcaggaggctcccggcgagagcctgggcggagtagcgctggggacctgtgaccgctgcatccagctaaccatgggacagtttggctctggccaccagccccttaggtgaggactccatcaagggcccactgcccattccccatcatggaggccgagaggatccttccagccaggggagctgccctttgaaaaccgtggtcgagtcctgctggttctccctgccagccaccttcaagagaggctcctgttcctgctggcccacggatggggaggtgggccctggacgtcgcctttgtgtggaaggcagctctgaccctgggcctggtccttctatactactgcttctccataggcatcacgttctacaacaaatggctgacaaagagcttccactttccgctcttcatgaccatgctgcacctggccgtcatcttcctcttctccgccctgtccagggcactggttcaatgctccagccacaaggcccgggtggtgctgagctggacggactacctcagaagagtggcccccacagcactggcaacagcacttgacgtgggcctgtccaactggagcttcctctacatcactgtgtccctgtacacgatgaccaaatcctctgctgtgctctttatcctgattttctctctcatcttcaagctggaggaactgcgtgcagccctggtcctggtggtcctgctcattgctgggggcctcttcatgtttacctataagtccacgcagttcaatgtggagggctttgccttggtgctgggggcttcgttcatcggtggcatccgctggacccttacacaaatactcctgcagaaagccgatcttggcctccagaatcccattgacaccatgttccacctgcagccactcatgtttctgggcctcttccctctctttgccatattcgaaggtctccacttgtccacctctgagaagatcttccgcttccaggacacagggctgctcctgtgggtgcttgggagcctcctcctcggtgggattctggccttcggtttgggcttctccgagttcctcctggtctccagaacgtcaagcctcacactctccatcgctggcatctttaaggaagtctgcaccctgctgttggcagctcacctgctgggcgaccagatcagcctcctgaactggctgggctttgccctctgcctctctggcatctccctgcatgtggccctcaaggctctacattccagaggtgatggtggccccaagcccctgaagagcctgggctccagcgctgacctggaactgctgctccggagtagccagcaggaggaagaggacggggaagaggaatattttgtgacccagggacaacagtgaccagcccaggagcagcaaagcaggccactctgtggtcatccctgctggcagatcttggccaggtccagcagcccagccggtttctcagagccgctgcaagtggtggcctcagagcttcctgcaaggactctgagcctccggctcttccctgtggagcttggtcccaaaaagcgaatgccaggctcacataggacctgagctgtcagtgaagggagccagtggcctgtctccaccattgttctggttctgagagccaaggtgaacgtgagagatgaggtagtctctcagattcggactgtggggtatcaggaaaggagtcatggagagactaggcctcatcacctggactgcagcttcctcagagagtagatttatttatagttgaaataatgatttcctctccacagcccagtgttgcctaaggcatgagagcagggagagccctggggcctggcctctcctccgttccctgcctggggccttgtcctccgctccgccttctgtagcccatgctcctgtttgtgccccaggccccatccttggggccacaccatggacccaccgcaggaaataaatgagtgtttgctcagtaccagcctctggagactaccagtgcctcagcc

SEQ ID NO: 133 - protein, 364 aa, Mus musculus
MGRWALDVAFVWKAALTLGLVLLYYCFSIGITFYNKWLTKSFHFPLFMTMLHLAVIFLFSALSRALVQCSSHKARVVLSWTDYLRRVAPTALATALDVGLSNWSFLYITVSLYTMTKSSAVLFILIFSLIFKLEELRAALVLVVLLIAGGLFMFTYKSTQFNVEGFALVLGASFIGGIRWTLTQILLQKADLGLQNPIDTMFHLQPLMFLGLFPLFAIFEGLHLSTSEKIFRFQDTGLLLWVLGSLLLGGILAFGLGFSEFLLVSRTSSLTLSIAGIFKEVCTLLLAAHLLGDQISLLNWLGFALCLSGISLHVALKALHSRGDGGPKPLKSLGSSADLELLLRSSQQEEEDGEEEYFVTQGQQ

SEQ ID NO: 134 - DNA, 1884 bp, Mus musculus
agtgcccacctcgagcttccggcaggaggctcccggcgagagcctgggcggagtagcgctggggacctgtgaccgctgcatccagctaaccatgggacagtttggctctggccaccagccccttagccaccttcaagagaggctcctgttcctgctggcccacggatggggaggtgggccctggacgtcgcctttgtgtggaaggcagctctgaccctgggcctggtccttctatactactgcttctccataggcatcacgttctacaacaaatggctgacaaagagcttccactttccgctcttcatgaccatgctgcacctggccgtcatcttcctcttctccgccctgtccagggcactggttcaatgctccagccacaaggcccgggtggtgctgagctggacggactacctcagaagagtggcccccacagcactggcaacagcacttgacgtgggcctgtccaactggagcttcctctacatcactgtgtccctgtacacgatgaccaaatcctctgctgtgctctttatcctgattttctctctcatcttcaagctggaggaactgcgtgcagccctggtcctggtggtcctgctcattgctgggggcctcttcatgtttacctataagtccacgcagttcaatgtggagggctttgccttggtgctgggggcttcgttcatcggtggcatccgctggacccttacacaaatactcctgcagaaagccgatcttggcctccagaatcccattgacaccatgttccacctgcagccactcatgtttctgggcctcttccctctctttgccatattcgaaggtctccacttgtccacctctgagaagatcttccgcttccaggacacagggctgctcctgtgggtgcttgggagcctcctcctcggtgggattctggccttcggtttgggcttctccgagttcctcctggtctccagaacgtcaagcctcacactctccatcgctggcatctttaaggaagtctgcaccctgctgttggcagctcacctgctgggcgaccagatcagcctcctgaactggctgggctttgccctctgcctctctggcatctccctgcatgtggccctcaaggctctacattccagaggtgatggtggccccaagcccctgaagagcctgggctccagcgctgacctggaactgctgctccggagtagccagcaggaggaagaggacggggaagaggaatattttgtgacccagggacaacagtgaccagcccaggagcagcaaagcaggccactctgtggtcatccctgctggcagatcttggccaggtccagcagcccagccggtttctcagagccgctgcaagtggtggcctcagagcttcctgcaaggactctgagcctccggctcttccctgtggagcttggtcccaaaaagcgaatgccaggctcacataggacctgagctgtcagtgaagggagccagtggcctgtctccaccattgttctggttctgagagccaaggtgaacgtgagagatgaggtagtctctcagattcggactgtggggtatcaggaaaggagtcatggagagactaggcctcatcacctggactgcagcttcctcagagagtagatttatttatagttgaaataatgatttcctctccacagcccagtgttgcctaaggcatgagagcagggagagccctggggcctggcctctcctccgttccctgcctggggccttgtcctccgctccgccttctgtagcccatgctcctgtttgtgccccaggccccatccttggggccacaccatggacccaccgcaggaaataaatgagtgtttgctcagtaccagcctctggagactaccagtgcctcagccc

SEQ ID NO: 135 - protein, 364 aa, Mus musculus; identical to SEQ ID NO: 133

SEQ ID NO: 136 - DNA, 99161 bp, Homo sapiens
atgggtaccattgtaggtgcttggtaagcactgaatgaactaatgcctgcatgatgccagctggcggcggtgacagccgcagtttgcataaaacactgcttacactctggccttgagccttctgttcagaggggccagggatcccagctgagtcacttgtaaggatccatgtttgcagctggtcttactgccagagagcccaggaggaggctagaggagggcgaaaggcacaaaactgggtctgaatgtgcaaccctagcttgccctggcctaatgttcttgactgcaaatgctgcccttttaatccatcccgcaagatgaagaaaatctgaactccctaggctggcattttggggccactgcaacctgcctcttggctactttaaccaccacagttacaaacaacctgtgagccccaggcacggctggagctttctcaccctcctttaggattctcccatttcctctatctgggatgctctctccctactcaacctattgaagttgagataattcttagaaagtttcatacagaaaatatttcacaaatgtttcgtattacttctggatcgcccaagttttaagttgtaatggccccagctggcctgagctcccagaagaaaaagcccatgagatacttatcttcgtggttcattccatggttgcccagcattagactggacataagaaaaacaatttgttcagtaaaagtaaacaagttaccattttttggatgctcactgtatgcagaacactagcaggcaccggggttccaaagcaagcccctgattgagcgcgggagagacgcagacaattacacggctgtgctctgagcctgagggacttcgcggaggacaaaactacgctgtacctcagaaagaccagaccacctcagaacccgaccacaacagacgccccgcccccgtgctgccccgccccgccttttcgccccggctccgcccagcccctgggtagcttccggcggaagttaccgcccgtgccgcggttcggcggcggcatccggcctcgcacttccggtggggagattccggcctggagctcccagggccgaggtgagtgggtgtgcggccggcctcccggcgcactcccagaggctggggggccggggctggagaagggaagcgggctccccacccgggatctgcgcgggttgacatggggcacgccacgcccctgcccctccccgggcctcagtttcgccgtctgtggagggggcaggggtctccaagcgccctcctgcaaggcacctgccggacgccggctcatctggtatttcctgagcacctgcgacgtcctgggtgcgggacccgggccggaatcggacacggccctgccctctgagaggctgcttcccgcggtgggattggggcgggcagtaaacacgtgagcaaacaaggaaacgtcagaggtgggagtgccacgaggattgggaggggtggggcattggagaaagtattcagccaagcggaggtctgcggaagggagctgaaggcaggaagagcagcaagtaaagaaaaacacaggtttgatgtgtttgacacgtggcagggggccgctgtggcgggtgctgggaccagtggcagaagaatgaggttacagaggccttccttgtggaccaggctgaggagctgggcttagccttagggcatgatctgtttcgtgtgccatctctctggctgctttatagattccaggccttaggggcgaaagaggaaacagggagaccagttagaccagtggcagtcagcaggtgaaagataattgtggcttagactgtggtagtgggaatggagaggaagagaagtagaggggtcaagaagtgtattgaaagtggaactgacagggcaggatttgagaaatgacagaaataagtggtcaaagatgacttcatcatagatttttggttttggcttaagtaaccaagtgtattatgctggcatttactaaatgactttgggatagattgggagcgtgagaaataattacgaaatcttcttagggcatcttaagttttagatatttggagtgcagctaccaaataggcagttagatatatgagtctgatacagaaaaggtcagggctgatgtaaagaatttagaaatcattggcaagtggattgggtaggatgagattatgtagggtaagatttaagagagaagagaagccaggttccaagctttaggcacccaatttttatagattgagttgacaagaaggtgccagcaaaaaagaccaataaggagtccagaaaagcagaagaaaaaccaggagaatgtggtatcgtggcacccaagagaaggttttttctaggaggaggaagtgatccattgtgtaaggtaagaatagagactaagccggcccggcacggtggctcacgcctgtaatcccagaactttgggaggccaaggcgggcagatcacctgaggtcgggagttcgagaccagcctgaccaacatggagaaaccctgtctccactaaaaatacaaaattagccgggcatggtggcacatgcctgtattcccagctcctcgggagcctgaggcgggagaatcacttgaacccgtgaggcggagtttgcagtgagccgagatcacgccattgcactccagccttgaaactccatctcaaaacaacaacaacaacaaaaagaatagagactaagccttcgaaggggcagcagggaggagggtgtggtgactcattggagcagtggagatgggctgaagtgagagcagggggtgaaggagttggactggcagtgcggggtcctctggggaagtttcactgttaaggggaccaggaggggagtaagcctctaccatgagccagcatttaatgctgtacctgatgccactttacagttggagaaactgagtccagaggtcaagtaacttagggtcacacagtagtgagtagggacaccaggatttgattctcagtgtctaactccaaagcccacactcttaagcactaaaccatgctgcccaagttacagttaggaagatggagggaagcaggtgtgccagtgatgcaccagccagccttaccttgatgtgactgctgcccccagctaagctgctctctgtggaaagtggggcagaatatggactttccttcctgagcaaatgagatttcaaaaagagttgtttactcctttaaatcttgtttcccttataaaataagggtggggaccttttcagtttcacgtctgtgtctccagtggtgggcctacaggagtgcttgataaatgctcattaagtgcctagatgatctccagggacccttctagctgagatttggctttgtgtttgggcataggtgaccttctgaatcccaataagaaaatgagttaaatttgagacagtgcttcttgtaggcggggtagccatagggacttattggaggcaggggaactgggccaggtctgtgaaggaaggtcagcatttgaacagtggagggagggtgttgcggtgttgcagtgctgcagcaggaaatgcagcaaaagcaggagctgcaagaagttggttaacagaagagtgaacagacttccctggcttggaagccacaggaggagccatgagggaagagtgctcagaagaaagctctgttagtgccagcatgtcctgtgagtgcctgtcacaggacagggtcagcagtggttctcaacagggagcaggtttgatcctcaggtgacatatggcagtgtctagagacatttcttgggtatcacaacttgggatggggggaaggatgtgacaggtgtctggtgggtatgggccagggatgttgctaaacatcctgccatgtagaggatgggtcttctcacaaagaattatctgtccccaaacagcagtaacgcccaggttgagaaaccctggcgtagaggaaacagtgtgggttttgagatctgtagacgtatgtttgaggcccatgcgccctctttgttggaggagcctgatggtggtggttgcaggagaagtagagagaaccgtgtaggagactcctgcagtcatttggggagaggatggtggctgagatggtagtggtggagttcaggacatgtgctcatatttgggatatttctgaagatagagctgacggtatttattgattgaatgtgggctaaggggaagagaggaatcagatgagcctaaggcttttggcctgagcaactaggagagtagtggagccatttgctgggatgggaagtaggaagaggagcaggcttggatgaaatgggggtgtggaaaacacgagtcagtttcagacactctagatgtgagtgagatgcctgatattagatatctaagggaagaagaggttaggtaggcattggatattcttctggagttcacatgaatcagagccggggcatatattgggaagacatcagcttacagaaggcatttgaaggaatgagaatgcattaggtcaggtaggagtctcaactcattggatctgacacctcttttttattacaaatattttgtaacagtcccttttattaccctaaaatgaaacatatgattaataaaaactgcctacacataattttttaaaaatcaacaaatgcagccgggcgcggtggctcacgcctgtaatcccagcactttgggaggcaaggcgggcggatcacctgaggttgggagttcaagaccagcctgaccaacatggagaaaccccatctctactaaaaatataaaaaattagccgggtgtggtggtgcatgcctgtaatcagtcccagctactagggagcctgaggcaggagaatcgcttgaacctgggaggcggagcttgtggtgagccgagattataccattgcactccagcctgggcaacaggagcgaaacttcgtctcaaaaaaaaataaaataaaatataaataaccatgccctataacataaaaggaaagtaattgatagtaaaacaaaatatgtttcaatatgtaagtttctgggcacaatagtgctggaagttgcagtgaagctgtcccttctgtgtggaccctctaggagtgtgatggccacagacacagactgacacagccgtgttgtgtcgcacctcgaaaaccactagtgccattgctgtagatgatgtggtttttccagaatggacacttttggtgccattttgagaccaattttgaccattttcagtctcccttcattgtacataggcgtcttattcttggaagtgttagttcacagcagaaccatggaaacactgcactgtgtttacatgtaaacagagttacattctaggttcagataattataagctaatctttcacctatatggatgtcaaagtcgtgcgggatgcagagcagtaattggctatgtggactgccccttctttatccctgcttactgaacgccaggagcatatccccaaaataccgccacaggtttccaaagctcctctgaagacaactgtagccccagagattcatttggacacagccagctccctgtttgccccggggaggggaaatagtaacaagagttccagagtgcagaatggaatgtaactgctcccttcagaaatgttggggtgggagatggagaatgtgtctgatcgtgaagcctaggaaggcttcgagaagaaggtggcgtttcaataggatgggaatgtctcaaaggaggatctgtggttgaggggggcacccagatgaagcagcaggtatcatcacataacactggacctgaggctcctccaggcacagacaggtctacccggcatgctccgggcactcatcagggttggctggattgacagggaggctgggagtggtttcatttggcaataccgtaaggcaggctctgcttccagggagtagtggttacagcctggtcttacagtgttccagccgttagagtgttggtttccttctccatttttaacccctaaagaccagaccagtcccctgaaaatcgcatgcctgctctctgtcagtcatcaaaccagacggagaacttaaagtacaccagctgtgcgtaaggccactgtggtcttactggtccctatctttgtgccgctcgtagcctctcaggggacagacattactcaaatcacaccctgcacaagtgctatgaaagagaagtaggagagccgtgaaagcaacatgtatctcaggggactgattcaggggatggggtggggttccctgaagaagtgacctctgagctgaagataggtaggattgatgaaggactgaagggtgggtgcagtgttcgttcatttccttcagacaacgggaagaaagctggtgtgtttggggagctgaaaggcgcccagtggggccaggtcctggagagcctgtggctgagactgggaagaccagcagggccagatgaggccatgggagccgaaagaagggtgctggtctttatcagaaaagcactggaagctgctgaagggttttaagcagtggcctgacatgatcagtttgtgttttaaaaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaaggtaccaggaggccttgctggggcggggtgctgggatgaaggtggccagagccatggctacggtgcccttcatgtttaacaggaaggcacaagcttcaaccagtctaactggaagccagtcacggctgggctggaacagggccctccaagcctgccgtgccagggttccccttcagtgtttggatccagggaaaccaaggagagcggggggtgtgaagggatgagctggggaaactggggctcaagcagcagctatttaccccactagagaagtatttcaatattttaataagtgatacaacgtagtgggccgcagtggctctcacttgggcataggccgtgaggaaggctgggcaggtagctcacaggtgtgttgaaatggtggagacagcaccaggctaggattgagtctcttggctgccacctgtcttcgtgacctaagagtctgtcattccaagcgatgataccgtaactaagggccctacacacatagcaaggtcctcatgaaccaccgaatgagccccactccagcagaggggcgaagaggaagagggagccggtggggggcaggctgtctaaaccaagccggggtgtctgctttgggctccatacagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacaggtaggtgggggacctcagtgagggcagagcaggaagaggggctggggaaccataggatgagaacaagagagacacccgcatgtctggaagccaagtccctcccctcttcctgcactgttcctcctctgccctcttgacctggcctcccaccacccacgctgctgcctcttgtgcactgcgtgccttcccactgccccaccacacacccacaaaaccccccctgcacctgcggccccgcagctccctctcctgccagcagacaccgagcctggagtgcagccctcaggcctggagataagtggtgagcaggcagggtccctgccctcgcagggctgtgacacggacatggagggcactacggagcccagggaggggaccaacccaaggccggggcccgtggctggtagaggaagatttcctaggccaggtgccaagtaggcagagccctgaaggatgcgtgggactggttggccctgggaggaggggccctcgtggcccgagggagatttagtgccagctgtggggtctggaagggaactcaaagtgtttcaggatactgagaacccggtgctggccagaggaagtgggaaaaatgagaactgagagggtgggcaggggtcatgtcctggaggccggattccccgttccatcctgagggaaaagggtttccagtaagggatcaaccagatcaggttaatacctccgctcagggggctcgccggagtgtttgtggaaaccataccggcccagccagttggaatgggccccagccctaatgctagagcagcccccgacctttgggggccagatattaaccctttagttgctggtggaaaagaaggcccaagggccccacaggaggcaccgggatggttcagaagtgggggacactcaggtgcctcagggtaccagcccaccccagcagagtgtggacctcccacgctgtcctgtgggtgcctgtgtcttcacagctctggcgacggcgcttgacgtgggcttgtccaactggagcttcctgtatgtcaccgtctcgctgtgagtactggccatgccctgctgcctcccttcaggctgaagctgtctgtctgtccagcggggtgtctgcacacccggctgctaggccagccactccaccactctgggaccagcccttgctctctcagcctctccctggcacccagcagctctccgggaagtcgccagcctcttccgtaagcccagcgcagaggagatgctgtgcccacctgccaggcagcgtggggaagccagggagctctcccagaaccccatcatcagagcaggggaaggcaggctgcaaggccacagacaggtggccactggtgggtggtacacgcagccgcagcagagccctatgtggcctgggggctacacaagagtttcttcttccctctgatgttttgcttcagagagcactgttcctgccttcttgtcctcctacttctcatccttccttcccgctcctgggctctgccgagggttaggtaaagaacaggactcagggagctcaacgtcagacctgtaacctcttctctctggtgataaccagaggcctcttagtcagagattccttctgattaaaggtcgcttatcactcagatgacagcccagctctgtttggtcatttcgctcagtgatttgtgctcctgctcctttctcggtgatgggtctgagccctgagctccagcagtgcattgtgggtaattttgcttccaggtacacaatgaccaaatcctcagctgtcctcttcatcttgatcttctctctgatcttcaagctggaggagctggtgaggccccagcgtctcttgtgtccttcctgcccccacagatgctaagaataaagtgggagtctgagcagtggcttgtcctgctgtgtgacagaggagacaagcccagtccaggtggcagtagatccctttctgagaagggacctagacatgggcaatactcagaatatttagaaaccagtgtggcagggtaatgaccaaaggtgaaagcactgcgggatgagggtcccagcagagctgggtctaggaagcaccctgctgtgggaggcagtagccctgtgtgttaggcccagggaggaggtgggaccacttgggggcctaggacagccgtcagtgtggcagagcaagcagggctgttggcataccagctgaccgtcagccctacatgctgacattggtgggcaaggactgtccaggaccccctgggatggagctgaagggtggaaggatttcttgccccaggggcagccaagatggctgctgaccccaggctccaaatgtgatgaacccttgaccctcaagacccccgagttagctgccactgctccccatcctaccagcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggtgagcacgtgccactcatcctccagagagaggaaccccggcacaggcagggcggaggcagggcagggccggaccagacctgatggtgcctgtcccccgccctgcaggcctccagaatcccatcgacaccatgttccacctgcagccactcatgttcctggggctcttccctctctttgctgtatttgaaggtacgttgggccttccctctcaagggcacctcagtgcagcagaccacagatcctcgccctgagcccaacacagtggtagctgcagagattattgagatcaaagatgcagtccctcccctggaagcgcatggtttggggtccagcatgataaacgctacagagaaagcacatataaaattcagggaacagtaacagtaagtgtgcacagagccctgaaagtgcaccagggctgttctgatctttttaaacataggaactcatttcatccttccaaaaacctggtgtggcagtactattattatcccccattttgcaggtagaacaaaatgaggcccagagaagtaaagataacttgcccaaggtcccatagctcgtaaatgagccagaatttgaagccagcagcctggctccaagtggtccagccctactcttaaccaccctatcttgcctctaaggagtggggaatcagggattgttccaagatgctggagtaatcaggcaagtcagaaaggcttcccaggccgtggtttggagggtgagtgggattttggcaggctgcagggagcaaggcatctcggaagtaggaataggaggttcagccatgtccaggaatataacctggggatgtgtgttcaaggagtgtgggccacgcaggatcagcagagggtgggcttccagagctgggggctgaagaccaggagccagcacacaggagcctggggacatggtcagttgttcctccactgtcgtcctccagggatgaggagagccctggagaactgtgtaggctgggaggtgtgacgccaccttcctttctttgatgttttgggattagcctttgtcccctttctgtttatccttcctcccagagtcccgtctgtaatgccctcagggtcattacagaaaattctgtcccacatccatttaagtttcaagcagtgaagcgtcttgaacctccccaagaaaattattctgaagccccgttgtccaggaaacttctgttcagggcctcgttttttttccttctttaaaatctctccccactccttcattatgcccccttgtaccaaacgccacactctccctcccctcccgtgtgtttacaccatgccccatctctgcaaaacctcatctgaaagcccctggtagtcgtcacttggcaaagctgcatggatttagctcctttaatcttttctggtaaattaatcccccaagcgccttcattacttatgctgctcttccccgaattcccttcaatttgccgacgcctttgcagttctgctgagcccagcaccaaacaagatgtcctacactgtgaggctgttttgcctggggggactgtcactcggcatttctttggtgcttccctccaaaaatctcaaaatactcgtccagcttccagctaccacagttgtctcttgtgcccagttctgggccccccttcaccctgtgctaatacaccacgaggactttcgtgtgggagggacgccgggagtcattcttccagatggacagtgttggagggaccatgactcctccgaaagtctaagctgaatttggggtagggggtgtgcatgcctgtgtttctggagcaaggggccatgtgtttgcattttctttttgggaaatgttcatcaagtgataccacgggttggagaaataccagtctggtcccaggcctctcattttatcagtaaggaaactgaggtccagaaaggggacacatctcagcccaagtcccacagctctgtactagcaagacctagattaaaatgaacgtttgtagggatagaattttgtccctgtttgtaggtgaactggctgaaatgtagaccaaggagttccctgagtgggctggggcactgttggtccttcgtcacttggtagccgccctaccttctttagcccagtagttaccacagctccaaagaccccatgaagtcagcagccatgagcccctccccacagaccagtaagggaatactgtccaaaggtgcagggcacttccatccgtctttccatgcagggccacccccctctacttcaccccagaggctcagacgagccctccccatcattccgctaggatccccatcatcccactaggatctccatcatcccgctaggatctccttcatcccactgggatctccttcatcccgctaggatcccatcatcatcccactaggatccccatcattccactaggatcccatcatcccgctaggatcccatcgtcatcccgctaggatcccatcgtcatcccgctaggatcccatcatcatcccgctaggatcccatcatcccgctaggatccccatcatcccgctaggatcccatcatcctgctaggatccccatcatcccgctagggtcccatcatcccgctaggatccgcatcatcctgctaggatctggcttgtattgcccccaggcgctctggcagccatcactgcttccctggtttccccaggtctcaggccatctgtgtgggatcactttataccttccatgctttttctctgggctgcagacagttagcaggtctcagtaagaactcactactacagtggaagatcttgtgtggttggcattgggctggccaaggcagcccaggacccggcctcccactctctctccctgttgctttcaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggtacagactcgggcgtgatgccagtcctgtcttagagagggagcccccaggggtttctcaccagcagcttcagtcccagctcctgcaccccagggccctgcagagaagagaaggaagtgccccattaggtgccaggcactttgctgagtgctgtgctggcccctccttctgccttgaccacagccctgtgagagggtatgatcactcccatcccacagacagggacacagatggagagccgcccctccccaagggcacagcaggggcctcaaagccagctctgactctgctaggcctggaatgcattcacattttaccttgactgccaactctggcactgggcagtggcctggagccacaggttgaacagcccctatccagactcatcaggaaagagttccgtgattgactggcggtgtcctccaaggccatggccagggctagtgagaccctgagaaagcacccctgtggccagccttgctgtacctctgcctcgcaggcctgtccttccctctcatacctcttctcacttctccttctccctcccacacatttcaacagtcctccctgttcaggggcagggagggacttttctctttggccaggcacacaccagtgttgaagcagtgttgcctaaacccagaaatgcaggcctgtccaagggtcttctggtggccagccgcatgctgaggcatggctgtggttcttggatgaacggccttgccagtcctgtttggagtctctgtttatagagagccccgggaccagttgtgtcttcagtccggggtaacacagcattctcacacataggctcagggctctcttctgtggctgccttctggggcagccgtcctttatccttgtggataaggcgcgatctggacaccctggtccccagcctgggatctggtttgcctcttttattcctgacagaattccatgacaagcacctcctttgttgcatctcacaaaaggaggctggcgggacagcgccgcaagccggccgggtcccctgacctctctgcctgcctgggcccaggatttcaggaagatcttgatctgcccacctgagtgtacctagtgcccccaccttccaccctcctggtcaagcagccaaatctgcctgttgatcatgctccctcctgcttctctgcccccaggaagtctgcactttgctgttggcagctcatctgctgggcgatcagatcagcctcctgaactggctgggcttcgccctctgcctctcgggaatatccctccacgttgccctcaaagccctgcattccagaggtaacccagagtcccttccagaagcctctgttttctgttcttctccctgtgactcttagtgattctgatgcaggaagtgtgcccggtggctctgctgccgtcactcctctaggaagatgtgggggtcatctccagagtgggtgggtggggcctgggtgactcagcacacatgcaaatcagagcaaaccaagaaaaccacgactgggcctgtaactgtggtctctctctatcccaaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagcatttcttttaatccttttaacaactaagagactaaagcctggaaaagataaagagctgcttaagtggccgggctgaggttcacatccaagtctgtgtacgtctgtgtgtgcacgtgctgcacgtgacatccacacagcctcctggaacttcatgggaccctggggcttgggctttccactcctccttggccaagtcccacgtcttctctagactgcaggcctctctcaaatgaggaagggagggggcaagaccccagctctgatgtgctgtggactgagtctactcctgtaaactggttcccgggccatgggagacccccccggcccttggggacaaagctttccaggcgaagtgctcctaggcactcacagcaggtggcgccattgcaccacactggctcccagagcccagctgccctgccacggctatccagacaccggcagaaaaggggtgcttggaagaggacagtgggtatccatgggtggggacaaggatagggcttgttctaaaattgtttccatcaggttggagtcactaaagctcgttcggttaagcccaggagaactttaatactttaaaaatgggtctgcaaacttcctgtaaagggccagatagtaaatatttggggtttggggaccatatggcgtctgttgcagctactctgccatcgtagcacaaaagcagccatagatgacacagacccagggtgtggctgtcccagtgaaaccccatttacaaaagtaggatccagcttgctggctgaagtttaccagcaggagaaccctcaagaattctcgagtccaacttccacttctgcagcaggagactgaagccaggagggggcggtgactagcccgaggccctcagagcctccgtgctcaggagtcagaccgagatctgcctctaattcagattcccagcacagactcagcaggcggaggtggagcaccaagggcgcttggaagcggcctcttatctggctcctgcacctctgccccccttggattccgcaagctcagaggccaagattaaaggaggctcgtgctccagctggatgatgtgggaagagccagccaaggaggggggccagggcctcctccgtcttagaggctgcttgggatgcaggctgcttgggcggcagggggagtctgccagagccccgctggctcaggtggatgagagcttcctgtcagctcccccactgcccgcctcccagcacagggagcaagcgttgctgtctggtgcagtaattacaaggtgcagagcgggggcccttacctcgcacatgttgggttcaatgacagcccttcatttagcagcaattaccagctgaacctaaaggagggctccctctcctcccccacccagcccacccaatcgcctggcctcccaggccagacagcgtccacctcggcattgagccctagaaccacccatgctgtctgcagccattgcatctcagggctgcagcatcaccatggcaacgcggtgcttgcacaggttgaggggaagctgaggatgtgacttgtctctccaaggctgtggtgtctgtccccacacagccccagctccgaggcttctgcagaaggggcggagagaggactgacctgcaggttcgagtttcaagtgcttacctgcccaccacctctcccaggggcccacagtggaaggaaggttaatggctccaatatgtgaggacgtccacagttggtgttgtggtggcggtgagaatgggctgcagtttgcctgtgggagggacctgagccatcaggcagggcccggcataccttcatcttcactccggtacccttttctgccttgagggctcaagggattgtctccatctgtttctgctttatcctgctgtgaaaaacctgaaaatcccagtggcttgagagtagttacatggcaccaagagaattctcctcatggtacttgctgcagcttcctgcatcacacactagtgatggactgagggtggggactcccaggccatccatttaggtcgacagcattcagtgagtactggctacatggcagacactgccggacttggggacagagacattcatttttggagtcagccttcctcccagcccaggaaagtgatgaggcagtgggctggggaatggggaagaaagaacagaaaagaccgttcactgggcaccatctaggcctttgccataggttatttaatctgtaacagcccggtgcagtaaggactgattgtatttctttcctagctgtggaaactaagttccaagtggttaagcataacgatggctaaggatacaacctgcagacgccgtagagtgagagacgtgtctctctttgctgtgattagctgcgtgcttttggacacgttgctgatcttctccgagcctgtttccttgtctctacagaaggaataataatacatacacctgaaggaagctactgtgaaggtgaaataaaataatgtaggtaaagcacacagtgctcggctcatagtcatcaccactcaggaaatggagcaggaaggacgtcacataactcgcccagatgagaggaggagccagcgttggagctctggccttccaagatccccatctctgctgcagtgtctggtactgagcatgcacttaacagatgctttttttttttttttttgacatggagtttttgctcttattgcccaggctggagtgcaatggcacgatcttggctcgctgcaacctccacctcccgggttcaagtgattctcctgtctcagcttcccaagtagctgggattacaggcacccaccaccatgcctggctaattttttgtatgtttagtacagggagctctaaagctgagatgcctttcagagttgtcccaagttggggtgagaggttcatggctttacgccacagcattttttgtatttttagtattttgtatttttgtatttcagtacatgttggccaggccggtcttgaactcctgacctcaggtaatccacctgccttgacctcccaaagtgctgggattacaggtgtgagccatcgcacccggcccagatgcttgttttttgaaggaatttccactagcggaaactaaagtggggattttacaggttctaacttccaaatgacttgccctgtaagaaggggctgctccctcccaccaccgcccattcctgccagcctccggtctcccagccatcccatggagttttcaccctaactgcacagccctgacatcagccacgtcccttcacccctgctttgtagtaaccaattagcttaacgtctgttcccatggttatttagtttcgttggcaactaacatacttccagaaacaggccagcatctcccagtcccaccaccatcctgctggtggggccgtcctcttctggatgtcagatgagaactctcctgctggggaacaacagaaggacagaacatagaaccagaggaaaatgcattcaaatgcattccatcagtgtttctggacagtctacaatgtgccctggccggtgatcgctgctggagatatcgaagtcattaaaacatggtctctgtcctcaaggaacttctgtagggctttttattttattttattttattttattttattttattttattttattttatttattagagatggggtcttcctctgtcttccagggtggagtgcagtggcacaatcatagcttactgctaccttgacctcctgggctcaagtgatcctcccaccttagcctcctgagttgctgggactgcaggcttgtgccaccatgcctggcttctgcagggctttttaatccagtggattccctgggaattagattcagagatggagattagagtgcaggacatttattagaaagtggtcttggaaaaattacctgtggaaaggagaaggcggcaggttagggcagaggggaagttgagcttcaaggcagtcctaccaaaagcctcagccaaccccatggggaactctaaagctgagatacctttcagagttgtcccgagttggggtgagaggctcatggccttacaccacagcattgacctgtcattggaagtgagcctgcccctggaaggagatgtgactttgggtaaggcagtttcttcaagacaaaccccaaagaaggatgactgccggactcccagcaactgaggaaataagtccttcactcccaaccggagacctgaacaccacatcacagtgtctaccacaaccagggtccacagtctggcttcagggatgaccagggatctctgaagaggaaagcagcatccagcatgtgtgtgcatttacatgtttttctgggagacagtgtccttgacccccaaaagattaagaatcattggtctatggaaagccagactcattcaaaaccgtgtgatcagagatgtacatggtagttgttcaacaaatataaaaggacggatggatggataatcgatggatgggttggtggatggctggatgggtggatggacagttaggtagatggatggaggggtagatggatgaaggatggatggatggatggatggagagatggataatggatggatagatggataggttgatggatggatgggtagatatatgatggatggatgaatgggtgggtggatggatggatggatggatgatggatgaatggatggtagatggataggtggatggatgggtagatggatgatggatggatggtggatggacagatgccataatagttgaatgtatgggagccacaggaaagggagcaaccgtctgggtcaggaggagagcagacttccaggaagagctgacccttttgaattgagtcttgaagactaaatagaagtttgctaagcagacaaaagaggcgtaccttgcaaggggaaagcagatgcgaaggtgcagagatgtgtgtgagcttgaggttggtgtgtttggctgctgtaacaatttgttcacccgtggctggccagaggtgcacatggggaaagaggagggggagcggggctactgatccatctttgaaaagaggaggtatcctgataggattgttccatcatgttattttgaacaagtaagtagatcctctccccgccccctaacagtcaacagtggtatctctagcatgaggagggggaagagggaggtcctaaaataatttcatgcgagtaaagagcattgggtcatttaccacatccttttccatgcttgagctccttagtcctgcaatccaccctgggaagctgttggttctgaacagcccctgctttccagatatgaaacaggctcagagaggccaagtgacttgcccaaggtcactcagctctttagccaccaagcagacagccctatagcccagcaggggcttacacctcccagagctcagcagccctgtggttgggatggcaggcagcctcactaccctcctgagattaggttactctggctagggacagaaaaggtggcccactgtagggggcccagggcctggcggcatcctgctggcaatattttgctttgcgaggaatcccccactgagcccaagcctcccatcctgttcctgggctgccccatgaattaaacatgcccccatggttaactcagtaatgcttttattaatagttaattactcaacgtgcactggggaaatgagactcactcaggcctcgtaaattaaggcagtgatctcgtgaaggaagccaatgggagttcattaccccagccccttccgacattgtacctctgggcttgccatttagcggtgctaaacgagatgcgctggcgggggcaggaaggggggacacgcggggacaggagccttctgcagggggaggtgggaactggaggatgagtgtccaccagtttcctgggagagaaagggccctaggagatggggcggaagcatcagctaggaaatgtgatccctgcaccttggcagcttgtcatctgcctgtgtttcctgtcactgctagggactcggcacaacctccagggattcccagatggggcaaggccatctgtctcaggtgtgggactccctcaccccgtctgggcctggaaccggccctgccccagcctctgctggtggcgtcccccctcgtgcagcccttcaagccctgggtagggaagagcagatccctcctcagagtccagggccctggcctcccctacccctgctctctcatttcacaaatgtcgagacttccccttctagtttttgttgtgtctgaagccaatttcccatcctgactgtgctgccgagctggataaggggcttgcgctaacctggtttcgtttttctaaatttacctttctcccaggttttgtttcccaggagacagaatcccctctatttatcttcctaggagaagacagccaatgtccgctttgaacctactatgtgccaggacctgtccctgtgggttatgttcgttggctttagtttctagccatgtgactccacctcccggggtgtctatttcttcatctgaaaatggagatgatcataggacctgagtctggagtcactgtgatgattaaacggagtggttagacactgcccaaaacatgtcagctctctctacggggcagctgtcattacttgcttcttcacaacagtgctgccagctggagaccgtccccattctacagataagcaaagtgaggatttaaataccttctttgaacttgcctaaggacacacaacccagaacttcatgttgccaaagtttatcatgttccttccttagaggcgaagtggggcaccgatccccactctaggagggcacactggccaagcctgggagccaggagagatctgcccatctgtccttgagtcacagggtctcaccaaggcagtgtaggatgagacgcaaggccctgcagttgggctggcccaggtccaaatcctgccatacccactggtcatcactttaacccctggaacctcagtttccacttctggaggaatgggcttgaggtagcacctggctccgtgggcggccatcagggcttccgtttggaagtgcctgacatctcgtagtcagctttcagagctctctgcacctgggctgctttatctgtaactggggataacaaaaaacgtctcttgctggattgtggaagaccctacagagataaagggcaccaatctgccttttgagcaggcaaatgtaaaacaggtgagctgctggtgcagaggtcaaggcccctcaaaaacagtttagcagagctgctgggggttaaacactgcctgggtggatgaggtgactgctggcttgatgagggctctcatgggtccgtgatgcagagggttggggacggatcaccacccaatgtcctcctcagctcccagctgctttgccaggcagaggtcagcctctcagctgtgactccccaggactgccagagccacaagcgggcaagaagtctggggtgggagattgaagcctccccggttagggagcacaagtcgtgaaggagtgcggctcggggttcatatataatatgtagcatcagatttaaatgtcactgctgcaggcggctgacccgggtccaacacaatgggccgcaaggggcagcgccgccgcctcttcatcttcctggcggtagctgaccaaagggagggagatttggtttcttaaaaaactaaacagttgttgagcactctggcgttgcctgggcaacaactgagggggagagagaagcatcttattgtttaaagttattcttgctcgatttcaaagggctgctctgaaaagaccacattctccaagcagcgtggctggtcctctccgccgtccccgccatgccatcccagctcctgccctccctcagcccccatccccacttcccagcctgaggctgcaaaaggggttgtagctgtgctggacatcagggcgctggagacagcctccctcatgcgctctgtgcgttcatccgcagggcaagcagaaacacagagacaacacgccgtgctactgcagccacccccgacctggacatgtgggcacaggggcactgtggtgcttggtgacttaggggtcagctcagcacaagtgcctgaacttgggagtgggcagggagggacgggggtgtctccatcgtgtatgttccaaatgtgaacatcttggttttcaagcccagacgggggcaaggagaaggtggccgtgtcaggtcattactcaggggcagtggctgagtgcagccccatgatccctcaagagcatgccaagtggcctgttgtctgcacccctctgcccctcctgcaacgctgtattggaattgtttattcatctctcttacccaccagactgttagctccctgacagcagggctgcgtctattcatctctgtgtattctcacaagctgcctcaaatcctttcaggagcaaggcaaattctgaagatccgaatgagatgtacatatattgttaattaaaaacatttagagggtgaaaacatacacatgatacagaattcagaagattcaaaaggaataaaaacccatgtgtcctggtgctgagtttccctccataggggcactcctagttcccagcatctggtggattcttctagagatattctgcttatatagacacagatgggcctaaaataagatatattggccgagtgcggtggctcacgcctgtaatcccagcactttgggaggccgaggcaggttgatcacttgaggtcaggagttcaagaccagcctggccaatatggcaaaacccccgtctctactaaaaaatacaaaaattagctgggtgtggtggcacacgcctgtaacccagctactgaggaggctgaggcaagagaattgcttgaacctgggaggcagaggctgcagtgagccaagatcaaaccattgcactccagccttggcaacagagtgagactcaaaaaaaaaatatgttattcatacctccagccccccatctagcacggggcccagtgcatagtaggtgctcaataaaagcatgttgaatggatgcatgcccagatgaacagaagtggatgaaggatgggtgggtgggagggtcagtggtagatgggtaaatagacgcagctcttaaactattagttctcttttcttttttttttttgagatggagtctcgctcttttgcccaggctggactgcagtggcgctatctctgctcactgcaacctccgcctcccgggttcatgccattctcctgcctcagcctcccgagtagctgggactacaggtgcccgccaccacgcccagctaattttttgtatttttagtagagatgggatttcaccgtgttagccaggatggtctcgatctcctgacctcggatctgcccgcctcagcctcccaaagtgctgggattacaggtgtgagccaccgcccccggcctattagttctcttttcttacagatatatggattccccgaaaagaaattacttgagacaaagacggcagacccggaattagacacaatgagtctggggggctatgttattctgagggagatgtccaataagcagttaaatttgtagttgtacccggtgggaattttattctactgctaataacaaaacctaattagaattttttgactccataaagccccaccttgatatcaagaatatcagggtcaaggtcactgtgatttcctcatggtcccaaaatgcttttggggaaagtgaccttcaaccatcctgttcatgttccagggaggaaaaagaggggcaaaagaaggagtcagcttcctataaaaagcctgttcctggaaaccccaccagatgacagctccagtatctccaaagcaacccgtcactgcagaggaggctgggagaattggcctctgagctgggcacattgctcccccaggtaatattgggggctattagtaaggaaatggaaaaagaggaggctactagcagtttttgccacatgggtgaagaatccagggagagagctggctggaggatggagatggcaggaaagcgagttccaggagtggcataagccaaagcagaagggtgaaagttaatggctcttttagttcctcataagctctgcaggctccagtctcaagatgcatcctgaatggggccacttctccagtctcagcctgctccaagccacgtgatctttcactggatggctgcagacccctagctcctggtctccctgcttcccctcctacccactactcagtgccccattctctgccccacagccaaagggatccttctaattgagaaatctgaatgcatcacgcctgactcagaacccttccgtagcatcccaccttgctgggaatacaatcccgagtcctcaccaaagccagaccttacatcatgtgtggtccatgcgcctctctgtcttctcccttcgctggtcactttgttccagccaccttggcctcattgttccttcttaccccagagcccttagacttgctgttccctctgcctgcaatgaatctgactcaaatcttcgcatggcagctcctttgcccactttatgttgctgatcaaataccacctccccggagaggcttccttgaccactccagctaaaaacccgcccctcctccccatccatctccactccaggagttaatgcatctggggccatggaccccttggccctggtgaagcccttctcagaataatgattttaaaggcatagacgaaaatacatagatttatcaaggcagccaattatatagaaatcgttttcaaaatatttacaaaacaaatgagtgatacagtactagatgcacttctttattaatgcattaaataacaagatctcgtggcagttctattaaccacaacaattttgaagcagtgatgagtgtcaatgatgtttcaaaatgtatgcaacaactgtaatgtgataggaaatatctgatttctgttggtgacaaagtcacaggcactgctaatactaccgtggtatgttgccaacatttataattgaagaaaaatgcgatattttagttacaggttagtgagataaaaatataatttttttcctcctctaacttcactgaccccctgaattctatctctagatgccttggggcagggggagggtctggttcttttttttttttttttataagtccctttcactacccaacatcatacatttattcgtcaacttgctttctgtcaatttttcccagaagagcagagattttatctgttctgttctctgctgtattttcaggacctagaacatctgccaggcacatagttgatcaacaaatattttttaaataaatgaataagcaatagaggaggctggaaagacagggaggcttgaggcagatgcgaggggccttgaaagccaagcacaggagctcggctgtgactggtggtgatggactcaccctgggaggggacgccagcctgggagaggtcactgtgcccagggcagccaggctaataggtggcgtgactgggggcgtgagcagactggctgtgaccaccttccaaaggcagctttcagagggaggcccaggcacacacgagtccctgcatcagctgtggatgtcggcagccactccactccctgctctccccgctcctcctctggtcccttggaggtcaagcagaaacttggagaagccaggcttacagccctgtcatcattcttcagcgtttcccaggcagtaatagtgtgccaggcaccaagggcagggcccacggggctctggggaaggagagccccagaggtcatgatgcaccgcggggacgtctccacggcagctattgcagacagacccagtgtgttggacccaggagccacaggtcacccctccccaactggggctggatattcagggccacgaaggagaagccagggaaatagccagcttctgggatcagacccacttgggtggaatttcagcttggctgcttgtttactaattgcatgcggttgagcaggtcacataaccactccaagccttggtctccttttttttttcctcgagacagggtgtcactctgtctcccatgctagagtgcagtggcgcaatcttgacccactgcagcctcaacttccagggcttaagcgatccttccactcagcctcccaggtagctgggactacaggcatgcaccaccaggcctgcctaattttgtagctttttgtagagccagggtctccctatgttgcccaggccggtctataactcctggactcaagtgatcctcctacctgagctttccaaagcactgggattacaggtgtgagccaccgcgcccagctcagtgtccctttctaaaatgagagtggttttttctacatcatagattttgggtgaggatttaatgtgggaaaataacagatctaaagcagccagctcaatgccagatgcatggtagatgctcaacaaatggttgcccttgtccttgtgaaaatagcaaaatgacttgacaaggaggccagtagtcctctgaagccagcatccctgcataacctgcctcaacaccctgcccaaaacggagtagggggagaataaggtggtaacctgggagccaataagctgggaatgaagagaaaagacatgttttggaaccatgtctggattcaaatcccaagctctgcagtttacagctgtgtgacctcaggtaaaccacatcacctctctgaacctcacttttctttttcataaaacaaaggtaatcccttcttctcacagtgctgtgagggttactggacaagtgtgcacagaatgtgtgaaagacctctgggacaggccctgacccgaggtcagcactcagtcaacagcagcttggaatacgtgatcacagcccagcccagagagggaaccaaggaggatacagatcataggattaatcccttgcatttgtcaagtgtttcacactgtggaaggagcactcactcacaaccgtcttggcatctgagcctcacttcagcactttaggaatgagaggatggagagtttttaacttttaagttcaggggttacaagtgcagatttgttgtataggtaaacccatgtcttgagggtttgttgtacagattattttgtcacccagatactaagcctagcacctattagttattttcccctgctcctgtccctcctcccaccctccaccctccaacaggccccagtatgtgttgttccccctttgggtccatgtgttctcatcatttagctcccacttgtaagtaagaacatgcagtatttggttttctggtcctgcgttagtctgctaaggatgatggccttcagttccatccgtatctctgcaaaggacatgatctcgttccttttttatggctgaagtaccgagagtttaattttttttttttttttttttgagacggagtttcactctgctgctcaggctggagtgcagtggagcgatcttggctcactgcaacctccgtctcccgggttcaagcgattctcctgcctcagcctcccaaggagctaggattacaagtgtgcaccaccatgcccggctaatttttgtatttttagtagagacggagtttcaccatgttggccaggctagtttcgaactcctgacctcaggtgattcacccgccttggcctcccaaagtgctgggattacaggcgtgagccaccatatctggtccttgatctacatttgacaaaagagacacagagctgtggtggcactggactctcagaagcaatctgctcaaaggtcaccagccagtaaggtttggggcaggatatgaagccaattatctcctttcctgtctcttttcaaaatagacactcattcattcactcaagagatggtcccaagctaagccccagggaactggcaataaataaggtagacatagcacctgccctcaaggaacttcgagtcccgtggactcaggatgctccccccacacttcaccgatttgaagggagacctatttttgctagattttccttcaaagaaggaaggcaagatctagcagtcttgcccactcgcaatcttgcatcacttgcccaaggtcactcagcatcagatctagatgacagatagggaagtgccttgagtctagagttatggccaggaataggagcgttctctgtccttggggatgacatccactcactaataagcccagagatagacactaggatcccaggatgaataagagtcctaaaatgaaggattccacagccaaatgcactgggaaaagctacaccatctccacccctccctgcaagtctgctgctcctgaacacactgtaggctctctgaaaatttctacagaaagaaaccacttaactcgatgtttctcaaatgtacttgaccatgtgaacctttttttccagccacacctactgaatttggagtatgataggcagaggaaagaacacaggctctggatgggatcaaactgtcaagatattaaaacacagaggagggaaggtcacttgcccaggtcactcagcatcagatctagagcctgggtctccatgctgttgctaacatgagaagatccttaaggatattctgcctggcctcctctctcagagaggtggccctgacaacctgctatgtggtagttcattctggagctgctgattccttcctagcctttgtgcaaattaaaagaaggtaccaccttcttctgggccaacaaaatcccatgtcagagcacatggattgcaaaagtgtagtatgggctggatttcagcccccacttgcccccttagccaagcaccctggtgcaggacacaacctgtgcaactgtacatggccacgcttattagccctttcctcattcctcctcactcattctacccttggccacttcacgtgaggggcgccctcccctcagtgctgggctgaggctggtgtgggaacagcccagttgttggggctgtacttccaaaccccaaagcagcatcagccaaaggtgctgactcagcaaaccttaatttatctcacaggccaggggtgcgcgtgaagcaattagtgaaataatggttatgtcgcactaaaaattatttatagagtcaccgtgcacacagctgtgattaaattagacaaccagggggactttaactgctggcggaaccagcatcccaggcccgggctgcagctggctgggggtggggcagggtcatgcttctggtctgctcacccactccaggcagctgagccaaccctgacccaggccaggacatagggggtctacctgggcaggggtcttgggaggaatccctgtcccagagagtctgcgctgccaggagccctgaaaataaacaagtagggggctttcacacattcaaggctgagcggcaggaagtttgttcacgtggagccttccgcagcccttcacgagtgaaagagacgtggactgagaaccagaaaaggtggtcccggagctccgcgggcttggtgttgactccaacagtggcccccgagagcccagatcccagctggaaaccatagatcggtgaagccctctcattttacagttggtgaaacaaaaggccagggatttcctctctcttgttcctccagcagacatcaggagacctttgatccagctgggatcctggatgaactctttcccctctctggacctcagtgtatccccctgaaaagtaaagtgttgcacaggcaacagatattgatcaagcacctattgccaactggatactgttctgtgtttatatttattgccttattcaagtttgcttatattcttctttagctcctcacaacattcctataaagtacgtattattgttgccactttacagatggagaatctgaggttcagagaggtgaagatatttgcccacagtcacacagcaagtgaggcagagccgtttttctaaaggcccatcagactgtaatgatagaacattgtggtacactgggctgagatgctgcaaaacgaaaacagaacttcctttgcaccggcttctgggcaggacacttgagatgcctcatttcatttcattagcagcccctcaggggtagatgtggaagctgagtcacagagtggttcaagccccctgtgattggcagggcttatttttatcagcaagacctgagctaaggagctccaaaggggttgcaaatggagctgcccacaggggcccagcaagtaccaaaaacagacctggatggtggctgtggccatctggactcccttgcaagctctgccttcaaatccatctgttaccatgatgcagccccaagttcaggccacccacgtctagagcacaaacctttgcccaaagaccagagctacctgtgtgatttcaggattctccctgggagctgatggtaccagctgctccgagaagtggcagccgggcggagagtgtgggtggcagtcaggaagccctcagggcactggcttctggcctggctcatctgccaaacctgggccctgcaagcctggcactcccatctaagctaaagatagtttcagaccatttcacaagagtcgcaagcccaatcacctttttacagccagggcatcttcttgcacctccctggccctgcctctaaacaagcccctagaggctcagaggagtggagtgactgggcagggcctcgaggctcaaggctcccccagccccctcccctcccctcttccagcaccttccccgatgcctccctcatgctctgctgtgaacaggcgggtccctctctccaatcacaattctgctggcaaaggggatgaagcttgctctccagatgcctcctgcccagtggcatctgatccaggaccctacaggaggagggctagagggggagaggccagaggattgggaggagctggctgaccctggcgccctatctcccagcaggtatttcccggggagtaacctcttaccccacaagacgcatcctccccctccttattcccctgcccctgcccaacatggctcctcattcaaaccagggctggcctctaggtgctcccaggtatgcgtggggcctgggtcggccctgagtcccgctgctgcctctggccacttagcatgcagtccttgtttgcgactgcagcaaccaaatgagattagcttgcctgctccagcaggtccccacttgccaccacccacggccctgcacagccaccagctgttctgggagcctcccacagccccagcctgccatctcacccccatcacagttgggccagtgaggggaaggtagggagagggtaaacaatcctgcccggctttgtagcccccagatccaccaccgctccccaccaggccttctggagtcagcagttgggggtagggatgcagagggagacaaacaggattcgggatccatccttgcttgtattcctggtcagttctcctcatgcctgtaatcccagcactctgggaggcgcaggcaggaggatcacttgaagccaagactttgatcttgaggccaggagtttgagatcagcctgcacaacacagtgggacctcgtctctacaaagtttaaaaattagccaggcgaggtggcacgtgcctgtaattccagctacttgggaggctgaggctggaggattacttgagcctgggaggtcaaggctgcagtaagctgtgatcacaccactgcactccagctagggcgacagagcaacaccttgtctcaataaaacaaaaaggaaaaaccaaaacaaacaaagaaaacttcctggtggggagcaaatcaggagggcctggctggcttcacctagactgcccctcctgttgaatccccagcccagctgccctccctcctctgcccctgcgggccacaggggagccagcagaagggcctggctcagcccgaggcctccctgcaaccctcccagccagtgaagggtgtggctggaaaaggggcccagtccagcccaaggagtgtccagggcctgtgcaggagactggcaggaagaaagttttcaagaaagctgagctccaaaccaggcgaccggagaggcgagaaacccctttgatgtcaggactcaggtgtaggtgtctcgtagaggattcccgtgttcctgctgacagtcacagctgcctccctgactgtggtcctggctcgcctgtgtcctccagcagcttctttctctgaccaccatgcccccatccctcccaggtctgtatcccacagaccccctgcccagacagcactaaaatcctctcgaggccaccccgaggctcctttcctagctgggctcccaccgagctgctgcccggcacacacctctcctcacctctcctcatactccctgcctgtctccttcccctccttcccctactcccccgaccttcgaagcccaggctgcggctcccgcactgcaccctcacctcacacttcagccctgcacacatcaacttgcgcttctctctacacgcacttgctgtgtagcttcgggcaaatcactgaaccactttgagcctcactttccccatctgtaaaatgggagtgatccctacttctctcaagggcagatgtatggctcaaattagatcacagctgtgcatgtccatctgaatttagaacagtccgagggattattcatcgggtttgacggcttctcctgggcttgtagatttcggcatgggtctttgtcccggccacacagatgctgctcagcatggttcatttggagcagacatggccccttccatagtggacagggatcccttccagcctctggccacaggcagatgaagggagctgctgcatgcaaaggcaggagggtgtggattaggagccatcacgggaaatggctttcttatcacgacacaaccgggattgccagggccaactctggaaattgaattgctcccccactccatgccccctcaatacctcttccctctgcttcctgctccctccctagccccatcccccatgacagggagagacccagagacagcgatgcaggacagagcaagtagagggggcagtgggggtgctcagagactgaggcagagattggggcaccaggaggcaagggcaggtttggcaaaatgccaaaggcagggcagggatggggccacagagggggccactcaggaattcagtagacagggggtgccaccctccccgtggaattccccaccaccccacacccgccaggccagagctttggccagccaggttggtgtcatctcctctctgttggcccctctccagctcccaccttggcgcctctgcagggcccgggaaggaccctgatggccagggcagaaccctgggctggcgcccacgggtgcttggatgtagtcccagtgagttcctggcagagccagtctgcaggtggtggggagcaggcccagtggccgggggcagccagctgtgtaatcaggcgggttctcaccacagccagcccaagggaggaggcgcacagggaggggcagagggggggcccagcccacctgcctccagctcccctggcagcccaacctagagtctctcggggtaaactcagagtccaggaggctcaggaggagctgccggaggctgtgcggaggcctaggaccccatgagtagacctccagccagcccagcccccaggccagatgcaaaatcaggagctaaagggtgctgcctcccagcctggcatggtcctgcctccccttcccaacccagcatcttggtgtatagcctaaaagtctcagaccctctcatgaactgacccctgccgtcagcctttagactctcagcccagaagtagccccttcccttagacccctctcttctcagccccagctcacccatctcccaccatgtgcccatccatgactagcctggtgctcaggagccgcagcagccagggagcccggcatgggggcactgcagccccaggaccacgtggcttcttctctactcagcccaccctgcccaaacacataaactctctctctctctctctcactcattcacaatgtattgctgaatctcaagttcatatgttatgagctccagggacctcttaattcaacctccatttacaggtggggaaaccgaagcccaagacagaatggacttgtccaaagtcacctgacaagggaatccctctaagccccagccagcccttccctccaagggtgccctcccctgggagtccccctctggcctcaggactctctctgcccagactttgtgggttctcctggcctctgcactcacctgcacctcccagacctggccaattgcagggccccaaagttaataaatcaaggtgactttggggacaagattcagcctctttctcccttgtccctcccatttgcataatcctggctggcaatatgataatgatgtttgttaaagacagagcacaataaattaataccgttaagttgttgctgcaaaatgcaaagcaggtaatttactgccagcgaggaacggagcctttaaactgtaatggattaactttcccagcagcaaatatgtcccccgagggagggaggcaggtgggtgggctgggttgatgataggggggcctgcctgcttcccagggttgggccaagtgtccaagccaagatcttaggcctgcacctatgtcagcccctctccattgtacataaggggaaactgagtcttgtgcaagacagggagctatggaaggccacagcagggctgtggtggtgacctgcgggctttgtatgacagcccattaccctctagaggagggggctgcagatgcctcatttgcacacctactctggaacgctcaggaggagctcctgttacagaccctgaacctcctcttccttgagggggactagtgatgtcctccccagaatcccccaggcccaagagaggcctcagctgcagagtcagtcctagcccaaggagggaaggatcctgggttttgttaggactgagaggaggggagtgggaaggggaagcgggggcgtgccaagaatggggttagaccttgccctgatgccctcggatactgggagggaggggctgtggaaggaggagaggaatgggtctctcgagaggaaaggtgaattctatggttgacggggaggggagtgggatggcggcagcggggaaggtgggtgggcaatgggaggctgggagtaggagcggctggcaggcctaaggagaaacccaggcactggcccagggcccctcaggggcacctcctccactggggctcagacagctccttgggtccctaggagaattgccgcagccccagcccagggcgggccggcaggcgggtctcagggaccccagcggaattctaatttctcatttatctctgcagcttctcctgcgatattaaaggggcgatgctctgcagttggctcccaggctaattggatttgggcctcctctcactccctggtgagggagggggatgtggcagccttgatgggggaggggatgtttgaggacttgggctgaggctgtggtccaaggccagactcctaggctacagtcctgaccatcatgtggccttcccaagcctctgcccctctccaggccccgcattccctcacctgagatgatgataatgatattaataatattagtaataaaaacaacaaccatgatttgcatagcatttcctagacatagacactgttcttagtgctattcaggacagcactcctcaccccctcatcctaacaacagcccagtgcattaagtatgattacgttcattgcacagacgagtaaactgaggcatggaggggttaagtaagttgctcagagtccagacagcacccacagtgaatgtctttcaggtttgtgaggggcctagaatcccaactttaaaaaccccgttacgctcaaataggcctaaggtgggggtgttactgcctgcacccatttcaccgatggggaaactgaggtctgacccagacatatttttagctttaattttctgtagctcccaccaagggctcccttccttctcctccaccccagggcccagggcgtttccagggtagaaggctggggcttcagagggcgcattcagtgcaagtgtctgaggtggggcaggggaacttgctcccaacacctgcctttcctccatcggccctgcctttctccttctctgagcggaggcctctgtcccagcatcctccaggcctgctggggtcccttgtcccacactgctcacctggagggaggacctcacctccttagcacaaattaattcccacatgtgccccagatgcaaaccacacagctctgcaagtccacagtggaataatggagaggggaggaggccgtacatggaagcctgtttcccagtgaccctagagaccggccctttacgcatgttgcctcatgtcatcttcatgatagacatggctccaatgcccattttacaaagaaacagaggctcccgtggaatgtttcaggccaggccacacggcaaggacctgattgagctgagattcaaacccaggtttatcttgatccagaacctgagctctggatacatcctcctgtgcaagagagaagttgagactcctttggaagttcagtatcagagggcctggaactggaacccaggatgactacagtggaaggagccctgcactgggaaccggtagacctgggtttcgatgtctacctggccccaaactcactgtgtagtcctgggtgagtcacttggcttctctgagctcaaaggcaaaatgcagaaaccaccgtgcctaccttatggggctattgtaagtattacaggaagtacaagtaaagcacttatcacagtgcctgacacgtaataggtactcaacccaggctagccatcattctgtggatgtattcatgctcacctcccaagactgctgggatagcacccgggcagagctttgttctgtgtcatggtctcagagattgccagagctagaagcattgagcacaatacccttgtctttcaaatggggaaactgaggcaaagggtttcaacaagtgagtggcagggcaaggactcagctccaagtgccctggtggcctccctgctcagcaaagatgacagttctccttccagtctccttttgccctgggtgtctgcatctgtctgtccaggcgtccctccctgagaggccagctggatggctgacccctgcagctctttccagtccagccgctggcaggaaccagccagaataaatgcaaagagaccccctctggaggctgttcttgccgtgtcccccgtccaaatgttaattttgccagggccttgataaatcttcctgtcgtctccatccgctggagacatagatttcatcttattgaaaggtgacactactgccctttggtaccagctatcaatttcaggtggcaatcagagtggagagcaacaaagaatcaggccccattaactccccttctgccaccgaatcctacctttaaatcttttggggccatcctacttgagatgtctgcttcacctgcccttccaaaaaggtgtcaggacctcatctttagcctttcagggcatgcctggttgagttcctttctcaggcctccagagccactttgcttcccagtgggcagactgaaagagtcaggaaattaatgtccagctcttaactgatgactatttgaagccagagtataagtaccccagctcctccctcaccctttgctggggaatgggagtggattgctctgtgatgtgagtcctattctccctcccagaattccccagcagagttgagctccagttgcccacagtagtaacaggcttgataaagcacccggtattggttgcctgcctttcctgtatcactttcccactgtcctactggtgcttcctgggatcatttcccaaataaattacttgcccttgaatccatttctcagggtctactctggaacccaaactgtgggaacactgaagattttttagcatctcaagatggaatgcactccactcagcagtggagatacaagaggcctgacgtgtattgattgcccacgacatggcaggaatcatgtgttttggctgctagatcagtttttcattcatgctgccagacagctctgggaggacttgccccagttttacagatgaagaaacatgctcagagaggtgaagcgacttacccaaggccacacagccagcaaacaaaagtcaatatccaaacccagggagcacactgtcttatccactccattctaccacctctagacaggggcatgaaatggagccagggctcacttccaggtacaatcagcagtgcagatgggtaaatttctcctgagggcatactatgaggcaggcagccttctgcaaggtgctaaggacagcgcaatgaaaagacgcagttcctgttctcaaaggggctggaagtggtgggggagatagacctgtgaaagactgtatggctgggacctctctcagagtgcactgcagcctcttccctgcaaaatcccatcttacaatcatgggacattcctgcagggggcagctgagaggttgtctatttcaacacattattatatggaggccaccgaggtctcaagagaggcattcacccacagttgtactccatggccagggctcttgtgtttgaactcagctgaggatttctgcaacagagccacaggattcctcaggctcacaagcaattctgaaaactcagaagtctctaaattaaaacaaaaaacaaacaaacaaaaaaacaccttgcaacataaaacatttaaacttctatatgccctaaggaaaacttaataattatacagacttaaaatatttgcatatcacaggtaaagggttaatacccttaatatacaaagagcttttgccaatcaataagagaaaaacaaccagaaaaatggacaaaagatagcagcagaagatgcctgtgtaaggcgttaatgcaagacctctggacttccgaggatccggagggtggtaaaactgttattacttgttaaataaatgcttattcattattaaaaaatccatttggactgcgggtcgcatgctactgcttgttaaatctgttaaagtgctgggaggactcccagatgccttatttacagttacgatgacagagaaaagtggccgaatgccagagccacaagcctgttgtgggatccacttcttgctccctctgcctgtcctgtgcctgtggtccctcagtcccaaacaaagtggccttagagccaaattgcccctgcagcctgggtaaggctgactaaagaggagtttggccaagggtcagaatgcataggctcggatcccttatgtgacctccactcccatctctataaatcagtttccccatctataaaatgggtaggttggcaccaccgatattggaggtcactgccacaccgacaggctagcattccagggtggggggtgggggtgtaggcagtggtgggaggagatttggcacctactaccctgtccccacctttacacctagggcaacggctgacctcattgactggaactcaagtaaggagcccttttaagcaacaaagatttcaccttacagatgaaaagtcagaagcccagagaagagcgggcacccacttaaagttgcccagccctgtcaggaccagagcctgggactcaggttccttcccttcctccttagaagggaagcagagaggccagaggcagatccagagcctggattttgccgttgctgggaagctttctctgcctccttgcactcagcgccgcctctctcctccttgactccatggagaccccccaccctcagggccagaggcaccttgcagcaggcgaaacttgtcagcccagcagggtccttctggtcctcccagccagccagactcctcatctctgctctgaagacagcctctggccatgagtgagcaatgctgtgctccacgtgctccacgccacctgatgctcgctgttggagacacgtccttccaggtgaagcatggccctgtcagggagtcactgggaggggcacccgagtagcagggaacacctgctgtctttccttaccctgggttttatgtcccttatcttttgaccctccttccattgctgcccggggtagaggggtcggtgtgtgccccgtgacggcaagggggagaccaggatttggggccaattctgccacttgctgtgtgactctaggcaagccacgtcacctctctgagtctctccataaccagggctgttttaaggaaacaattagataataaatgaaagatattagcacggtgcctaggacctaggcagaggtcgataaagagtagctcttattgttatctgaaaaatgggattaataatatctagcctaggactcttggaagggataatgacataatgcatctgaaacatatggcaacatggcaggggctccttcagtgaccatgctggggtgaggtgactccgaaacagggacattcagctcattttagggcaaggggcctattctcgtggctccaaatgctcaccagggtcatggccccctcatcagctcccacttggggctgactctggccccagccagccttagggtgttgtccaagctggagatgccagcctcgagggtgggtgggagccagggacccaggaagacacacatgatcaatactaagccaatctcttacaagattcccccggcctctggtatccaattgtaaagaaaatcactccgcacactagggagatgtgaaaaatgccgcagattacagtttgggatgttctgagtcagagtgagtgagtccgggattgtttcctgcagtaaataattcattcactttaaatttcgtggtttttttttctcaccagctccctccccgccacctctgtctcactgcctctcctgccagctccctctcaagtccactctccacccgggaggctcccatccctacctaggtccaggcaaccccaaaccaccaaggagctaataatacaaatgttttgagtctgttaatgacactaatcgtcttttgctgctaattagtaatgctgccaaggaacacttccttgttaatgaggccaagggccacccaggcaggaaagcctagttgggaaaggttgcaactgagctgggagccaggcaggagccaggcaggcgggcaccaaggaggcctctggcaagaccaagggcagtctggctggtgatggctcctactccggaccctgtcctctgcctcacatgctacatcacccagagaggatggcttgagtgggaggctggaacccggccagggggcaggtgagtggaggccagggaaagagatctggctagcggtggccccttcactcccatcatagacactgccaggccccagatcaaaagcatggaacaactccaatctgagtgccagttctaagacccatggctcaaatatgctaatggtgggcacctatgtggaatctcttagtacacagtaatggaatgtctggcagataactgttcaacaagtagaccctggggaggtgctgggcccccaaacgcagatcagattctgccttgatctccaggaactcctggcttggtggagggagacagacaataatggccaacatttattgatcacttactatgtgctgggcactgagccaagaactcatgcccactgcttcatttattcctccccaaatccccatgaggtgggtatttgagtggtttggagcgtttttgtttgtttttatttttctgataggtactctttctatttccattgtacagatgagaaatagaaggcccagaaaggtcaaataactggtccaagagtgcagtacagcagaatcagtatgtgaattcaggcacctggatctaaagccagctctttgaacccaagccctttaacagagaagtaagaagacggtttcaattcagtgtgctctagtctgcaataggagaggtttgggggttgtagtcctgggtgatgagtgaggcttccaggagggggtgaggtctgggtcttgaggggtgcataggagttagctgggggaagtaggagggaaagtagaaaggaattccaaaagatggggcactgtgagcaaagcagggcagcactcaggtggtctagcgatatctgagggtaaggagtgcagtgagaacagggagatatcatgctggggagcccaggagaggggatggaactgcactgagggccatgaagatctgtacatggagagccccagagaagacctgacttcaggatgctctctctggactacaggataaagggaattgtgtgagagagagacaagggagactggtgataaagcaggaaagggctggccagggattgtgcttgggccatgtgctactgggatggaaggggagcaagcaaaaggtgatggattgaaggtggaagcaggatggaggagtccaggaaggccacagcagcctcccaggcagatgcaaggagggccacctttcttctccgactcagggaaccacgctaggcctctcgggatggggacacagcctgcctattcaatcccagcttgagttgcagggggcccagacaccagaagctgataaggcaaggagtgtccccagcctgaaaggacccctggccaactacatcttctcccatggcaactaaaacccactatttcaatttcattcccttggattaagtgttgcctgttctctggtagggagatcatattatgccatgaactcttcgtagacagcattgaggactcaaattacatatcattgttttcaggggcagctttctggggttcccctagacagaataaattgttccttcctctgtggtcccagagtgcctcatatgtatgcacagccctgatgatactggagtaaggatttttctgtctgtcttctgcattaacctgggagctcctggagcaagataatggagcaagatcacaagagatcctttgttttatatgtgttcttgcaaatgagcatgattttgtataaatgcaatttttcgtatgtatctcccctcctagactatgagccctctgaaagtggtcacttgtcttattttatattgttttattttatttcaattatcacaaagtaacattgactttctttgggcgcatagttctataaatttcaacacacatataaattcatataagcaccatctgaatgcacatttaattcaaatagatggtattatgccatagatcccagttggttcctcgctcctttcatctcatgttttaaagatccgtccatggccatctctacacttgtctaacagttgccaggacctctgcagggtgtgtctcccatgtcttcctgtccgctcccccagggaggagaggtgggttgcctccaactcccctcaacacagcatgggcacaagaatcctcagacttgttcctcccagtcatgctgagaatttcactgaaatttacacccaggagcagaatctctgggacatagggtcagcatataaataatgatctctaaatgccacgtcactcacaaaagtgtcctggcccatcttggaggatgacccatgacaggctaggtggagccagcacacgtcactagggctgtgccaggtgttcaaatgctgacatctttccattctgatgggcaaataggtggttgcctgtgtagagtttcccaagggctcagcccacctccttgacacccagctctgccccagaacacctgactcttcccaggatccagcaactaatgggttacaagtggcccagcagggcctccagggtcttgctccaatggccattattaactgttacacattcgaatatcgtccttgtccatgccctgtgcaggggaacaaggcagagaggagctcagaggttgaggttcaagtcttcttcagcaggtcttggcaagccccctccccttgctggattcccacaacacgagatcagcacttgccagactttcctgaaacatgcttccatagcctcttagccactctgggagctgggaagtggttctcctcatttgacagaggaagaaagaagaaacaggcccagagagcggaggtgactcgcccaaggtcacccagtgagcaaggaacagagctgtgacccaagagattgaaccccagcacactcctgctttgaaggtccccgtgccacaccacagcacatgcataaaatgcaccgactcccacttcagacctctcctatgcatgagtagaggaggggtgaacagaattggcactgactagttggcacaatgctagattttgtagacatttaattaaacacttactaattttgattttgcagttttctttttgtattttggagcttatcttttcttttttccttttcacatcttgaacttttccataggcccttgacaactgcctgaatgctgcctgcagtactgggccaatctgtctctctgtctcagtcttgggacttttggacacccctaggctgtggccaatctggggagaagggagcacagaggtcagttagctgaggtgctccccttaaggactccaggtctgcctctgagactcaacatccccaaagaagaaggtttcccaacgcaggaggtccgtgctctggcacattccaggagctcagcacagagagagtctcaggcccaacagctggggtgggaacagcgcattcatgggggaggctggaagttattggtgaatgtttttaaaaggtggggaggtggggaaaagtggggacctggaatgccaggattccaggcttagagacttggtccaaattaataatggcgccaacgatacctacctctgttaagcacctactggatgccaagcaccatactcttatcttgtttaatcttcatgacatctgtgggatgcaagcagggcagataaacaaaatatttaaccctcagttcagcacgtaggatcaatcagaaccactgaggctgcagcaggtcctcacggccgccagaggagtcaacctttagtttttggaccttggcaagaggaggtgtccgtaggtgaaatgggagcaggagagaacatttggtccatgggctggccaggacaaaagtattgcaatatttttttgtgtgtgacagagtctcgctctgtcacccaggctggagtgcagtggcatgatcttggctcactgcagcctctgtctcctgggttcaagagattctcctgcttaagcctcctgagtagctgggattacaggtgcctgccacgatgcctggctttttttttttttttaatttttagtagagacggggtttcaccatgttggccaggctggtctcaaaatcctgacctcaaatgatctgctcgcctcggcctcccaaagtgctgggtttaaaggcatgagccaccatgcccggccccatactgcaatattttaacaagcccggctgaatattgcttcaggtcataggcactactaccacctgctccattttacagtcaaagaaactgaggctcagagaggtgccaccctagtggggaggtgctacctgaattcaaacctaggctgggctcactccagggcctgcaccttgaaccattaggcttctgatgtttagctaccttgtcccagtcccaggcactcacattctggctactttctcttctccacaaaggtttccctgcagttgccagactcaaaggaccaacggcagctcagacagaaggaagggaagggttaattgggccacagcccagggcaggcacagcaccgctcttgggcatggcagcctctggcacctgccctggcctttcatctccacaggctccaggtgagagaagccagagccagacctgccagggacccagcagcgtggcttccctttgattcccgtggagcccagaatcaaaagcaggcggcagtggccagtgccccagggtccccccggatggcagccccatgtgcccttttcccttaaccaccagcctggcctgagcctctgcaaggtgaggctggtggggggcccaacctgccggattctcaggggacaggccagagccagagaggggctgagggaggttccagagcagaggggaaggagagacagcagtgcaaggcatgggctcaggcccaggaccagctgtggggcacggggggagttccaggaggctggaggaggaagagagtgggctcagaaaagcacagagcttggccatggcccttcccggaggcacccctcgtggggttcaggtcgcgaggtgagagctgcggggggccggtgagaaaaagcagcaaatttaaaaggaattagtcaggaggaggtgacaggcccgttctgaagcaagatgaatgggtttcagttggcgaaaatgattctaatttataatctgcttcttgctgccgctcgccaattaattctctatagatacataaataggccgcatgtttgctttgcttcaaacgtaataaacattacactctgtccccttcttttgtgccggttcctgtcacggcattagtccccacagctaattcctcacacctgtctttgccgctcaagggagcggggctgagtggggaggaagtgcccagctccaggaaactcgaggcaccaggagataaattgctgatccaaaagctgccgacacccacagcgagcccgggctccccactcaggagacgcccaggcggcgagggagggagggaggcacaggggagtccctccatcttccttttgagactcctgtgtcacactctttgggaccatcttcctaatcctaatgagagatggagggaggggaaggatgccttgtcccatctgtggcctcagcccactgggttccagacacaccaggcccattctgcttccagcttttgcacttgccattccctctaccctagggagccacctcctttatgtctttttttttttctgagatgagagtctcactctgccgcccaggctggagtacagtggtggaatctctgcctcttgggttcaagcgattctcctgccacagcgccccgagtagctgggattataggcacacgccaccatgcctggctaattttgtatttttatagagacagggtttcaccatgttggccaagctggtctcgaactcctgacctcaatgtgactcacctgcctcggccttccaaagtgctgggattacaggtgtgagccaccacacctggcattctttgcatctttctttatgtttccccttcccagtgagttatttccctgactcccccgccacttcctaaaactgacaccccctcttcaactctccccgtgctcctttccagcttttaatttttccttggtaccatcaccctctgacattctatttattctgtgaatttatcttgtttattttcctccccaactgggatgtaggagcccatgagtcatccccacatttggtcctgtattctcagtgcttgccacatagtagatgctcattaatatttgttgaatgaatgaatgaggtggggagggggtgggagggagcagcagatgggacccacagattgaaatgacacctcactcctgcttgtcatctcatctgacccctgagagatggcaaaactgaggccaggggaggcgagacttgcccaaggtgacacagcgagttagtggcagggctggtactaggatcccagtccttggcctttctctaaggcagctcaggccaggaatacacctgccaaacatcctgccaggtgaggtgttgaggcaactgaaattcaggcaggtgacatgacttgcccaaggtcacactcatttagtcactgaaatgattgagtacctactatgtgccaggcaaggttctaggagatgaggatgtagcagcaatcaggacagaaaagatctctgccctcccagaactcacatcctagagagagaaatgggcattgggtgagttaataaataaatgtaaatgttaggaaggggtaacagctcagaagttaaagcagggtgaaaagattgggtgatgtcacagcaagatggaataggggtgaagtgccatttgccgtggggtggtcagggatgttctctgtaaacaggtaacagctgagcaggagcgccactgacaagaaggagacaaccttgcgagcacagagcaggaccgggatttccacttggatctgtctgctccaaagtgtgtatttttctccacgaaaaatgagcattcctggcagtaaggagcactatcgggtgaaggaagaagcactcagctctgagtgggtgaggtatgagttgaagtctgaagccttggtgagagagaacagacagcaagggatggagcagaggctgctcagccagagaccacatgggcaaaggcctggaggtggaaggcctggaggtaggaatgagaccttcaggcagaggtgagctggctctgggggaagcagggagcaagccctgatttgtattgtttatcatttcttttttgtggtgtaaatattctcaacctggccaatttcaagggcttgccaacctggcttgcaaaattcctggaaaaagactctaacaactggctttgataagccagcacaaaccagttccagcacatcactgcttcaggtgtcaacaagagaaaggccaggcagcatccacacagggaagacgcaagacagggcttggaaaattacgtgtggagcagagaatcctggaccccggaagggctcttggtcatcatgaaatcttcccccacctctcctcctttattttatgcaatagaaaacccaggccaagaaaagaaagaactagagacctgcccaaaacacagagagagttgaggtcggagccacagccggaagatcttaggcttctcaggatacctagcactttctccgtggcatccaactgcctgttcctaagaagtcgtcatctgtgatggccccatcaggcatgagagtcaagggctgtgctacccatgaggggcaggaggagggaagaaaacagggacatgtgttccaggtccagtggagtgcagaggtgggacagcttcatgccacctgctggattaatacttaagctggatttcaaaagataaataggagttttccagcaaaacaaaggaagagagggagctccaggtggcagggacaacattaaaaaagctcagagtggataaaagctaaaagagtttggcactaccagaatataaggtgcaagaaggaaacagctggagaggaagctggagaggcaatgccctgttcctcatgctgaagccataatggtgggctttcaggtagctgcagagaagctattcttagatgggtcctcctctcttgccagaacaacatgaatgaaatggtacggcaaagtccacttcctcatgggtgagaaccttcaggtgaaggaaggtccgggttccctggcatgttggccccagccctcctggtgctcagcaggtcactcggcccggggtgggtccctcgtcctcatccccttgcagatcccctttcccttcccactggcggctcttctctaggccaggaatagaacctcacatctgacaatcctcagcggtgtttaaatttaatgggcctttctgcttttttcctcctcagcacctgggctgggcgctctgcagcagccctggggagaggcaggtgaataattcagggagagtcggtgtttgaagtgtgtgtggggagtgtggtagggctgtctcaccccaccaccccagggaagggggctcaagagggaaggtccaagtgctcagtttctgctgtactctgctgtgtctttagggactttcagggaagctcaggggactcttattcccatctccacgcagccacctgcagtgtcaggcctcagggctgcagaagctgtctagggctgacaggtagggagagggaaaggagggaggcgcgtctttcccactggctttggatctgggtccaaagagagagagagagaagagacagagtgtgtgtaggagacagaaggttgggacctagccccagacagaggttacaggagcggggttagggagctgggatgtgggctgagatgtcatgcccagaagcagggcgggcccaccaggctgcgggagagcttccggtgtaaagctggatcctggcctgggccatagccactgtccatagtgctgccgttgtgcttaggccctggatggagtgccaagttcccaaggcttggaacttggcaggtgctgggctcctgtttttcccacctggccccaccccagcccaccacagacaaagtagcctttccattttctaaccttggcacctttccagcatttgcattcattcattcatgcatacctttaacaagtatttattgagcatctactatatgctgcattcggaggatagtgcagtgaacaaaacagactcagttcttaagctcctagaacttgtgttccatccctgcacccacttccttgaggaaaaagaggggaaaggagaggaaggagctggccttaaattcctgttcgtcccctgacttggtctgagtcgtccagcaagtcactttctccccttaaaccttggtttccccagcggtagcatggggacgataaccctgttttgtgagttgttgctgctattcttcttattaattacagcaaacacttattctaagtgccttacaaggatttgctcatccaatcttcaccatctctattttactataaggaaattgagatgtggagaggtgaagtcacttgcccagggtgacacagctggcaagtggcggtgatgggatttgaacccaggcagtctggctgcggggtctgcgaggattaacgccatgaggtggaggtgcttaagggcgcagcggcctcggcgcctgtggctcccgcaggctcgcccctccccgtcctggcgcccccagccaagggcggcctccccgtcccctcgaagttcccttcccatggagtcccctccccaagtagtcccctccccctccctgcggtcccgtcggccccggcggagaaagcgggctcgcagaggtgcagagcgcccggagtcccaggtggggcgccctcgttcgggtcccgggtccctctggggaggggctagggtgtgccccggctgctccctacgccccccggcgggctggcggccccgtccccgcgctgacatttctttggttgttcatgtcacggcccttcagtctgcgcagttttacaaatgtgctggcgagatgaaaggcgccgggaacagcgactggagaacaagttcggaaaagcttttaacttccagctcccacagacaaagcgggaggagggggaggaagggagggaagggaggggaagcacagagtggggagagtagaggaagggagcgggaggaggggagtgggaaggaaggagggaaggaggaagaggagaaggaagtgtggggagaagagagaaagggaaacggggcactgagagtgcgggatgaggacagagagaaccagaataggacaggcaagagggagacagagggagactgggtgccccgaagaaacagagatgggaagagacagagaaacagagagagggagacagacatggaggcagagagaacaggacagagggagggggaaacggaaagagaacgacagacgcagggacacagctaggagataagcagatggggggaggggagaagggtgctagagaagatgtaggggcaggtagcaagagactgacacccattcagaaacagtcagagagaccagagacactgagggggaggagacagagacaggagtggaggcagtcagagaagcgaggacagatggacagtgcatgagaaggcgacagacagataaagggatgacagagaagtgtagagaagaagaggaaaagagccagggagaatagcagagcctgaagctaagagcagcctccccatccccaacacacacgcgtgtatgcactcacacacacacacacacacacacacacacacacacacacacacccttcactgacccctgctcaaacctgcaggctccctggagcagaccctgctgttagggcgttcagactagagcagtggctctcaactgggggtgactttgcccttcaggagacatttggcaatgtcaggacacatttttagttgtcacaactggggagggggtgtgctgctggcatctagtgggtagaagctggggatgctactaagcatcctacatgggacatgcccaatgacgaagaattatctggcccaaatgtcaatagggccaaagtggagtgaccctgggctagagagagagaaatgcccatggacccagatgactactccaggggaaaacatgtcccctgtgccaagacagggctgtgtgcccttctgatggagtgggaaggagaattctcacaagcgcctcctcttggaatccttccctagccatgcctctctccccaagtccttcctcatcctacccaatccctggaggagtggtgtctctcttatttgtagactcaccacacgatataaaaaagcacacgttcaaactctaactacaaagcacttggcattttatttgcccagaggcaatattgcacaacagttcagtgtgcaggctttggccccagcctgccttggtttgaatcccagctctgccataaactaattgtgtgaccttgggcacgtttcatagttgcactgtgcctcagtttccccattatgaatttataaatttgttgaaagtaaaaggaaattatctgtgtaaaacatttaggagaaggcttgacacatggcacaggttcactaaatgttaactgttgttactatcatctcattttctcttcacatcaatgctgggggaagtggcttgcccatgtgtcacacagtctgcatggggcagaactgctctcagagcccaggcctgcccagttcttcctctgtcacactacactgcctcttgctgcccctgccacactgcagcaggagtcccagcttaccttctcccagaccagagtgagaggtctgacccaggcccaatgcgtcaacctgatctctctacttgccgtctgaatgatcttgctatttcaacaccgtgtctcagtttcctcatttgtaaaatgggctaatactagtatctgattattgtgaggacttaaaagcagaactatggcacacagcaagtgctcaataaacattcaatgtgttctcagagcctagccatagtgctcacaacagagtggacactcagagaaagtttgttgaaggaaggaagaattggaaataacggtagaatgagcctgaaaataggaaacattgggataggaaaacctgagggtctaataaagagtcatggggagctgggtgcagcagcacatgcctggtgtcccagttacttgagaggctgaggcagaatgatcacctgagtccaggaatccagcctggacaacatagtgagacccccatctcaaaaaaaaaataaaaataaaagagagagaagagagagaccagagcaaaagagaaagatgtgacaacagttcattcaataacatttattgagcacctactgtgtgcatgcagatgtgacagcaacagtgtcccaggccaaaacaacctgtggacaactaagtaggtctgactccagagatgaacagcacacaccagagcctggaggaagaggcaaagaaggaatgggaactggagcaaacagcaaaagtgagtcagagcgggaggagagaaccaaaagtgaagagatgcacctggaaggctggcctctggtctctgaaagcatgaaagagtggaggctaagaatagagaggagaggggaagagagagatggagaaaaggaaggcgatagaaaggcaaggctggaagagatcaatgaagggaaataaaccaagagaaggacgtaggggagggaacagactggcacagtggagaatacatctcaaaataaataaatgaatgatggagtttagtaggaggggccagaggggcagccagcaggagaggtgattccaatcatcagcaagacggactagggtgtggagatggagatggaaattggggaaggaggcgaggaggagagaaggataggggcgaggtagagctgggggtcctggagggccctgccccctctttgccatgaacttcagcagctgcttgtgggtgattaaatggctggtcattggcagcttggggggacagaggtctgcagctgtccagtctcctgttatccttcactcacctatctggaagccatggggaataggggggcgggcaactcctaaggggacctacaacccaagacaaagggtgggtctgtgggagtcactggtcctatcctaccatcaacgacctcatattgggaactcaggagtggggtgggagggtctcctccattaggcctcatcccagagagatgaagtagtaaggagagccaggcagccaggagaaagaaacagggccaggtggaaaaaacatcagggagcagaccagccggatttttaaaagaacggaaaacccaaccagcaaggagtttctgggcagtgggaagattttattgggagacttctccaggtcaaggtggcaccaagttaaggatggaggtgtcttgttttgcctgcttactttgttggttgcaaggatgtccagcgggactctccagaggaaaagcccacaagtttctctcccggggacacccgacctcccacctgcctggagactcagccctgggcacctggtcggtgtccacctcaatgcacagtgactgtttctgaactggcagatctggtctgtgcaaggtgcctttctgggcagcaagccggggcggccactgttcgagaagcctgctcctaccctggcctgcgcccctgctcctctgaaggcggcctcccgcagtagtcagggggcggaaatgggaagccctattcgcagtaaaatcaggtggggaaataggctctggtctcaaactgcggccacctggggagctgccaggcgaggaggtagatggtccccctcctgggggcgctcccttcgcgcggatctggggttggaggagggaggggcactgtcccctggggggtttcctgggactgggccgcccgagagagggaaaggctgtcccctcctggtgtaggaggggcgcgatccggggggcgggggctggggttccccggctgcgggggtccgggccggcggccgcctgcggcttggcgctgcgcggcgctcctgcccggcgggccctgcattctccgagtctccaccagaggctgcgggaggaaggaagggatccgtcccttgcacacttccccccagtcagacacgcacactccctcgctcccgctcgctcgctcactccctcgctctctcgctctctcgctctctcgctcacacacacgcgcgcacacgccgccgcggctccccctctcgctcccgctctccctccggctcctgcgggcggccgcggggctccggactcgcccgctgcccgcgccggggctcccgccccacgcagcgtcccgaggcggcaggactagggggagccccgggccgctccccgaggtaagagcgcggggtgccgcgggaggagcggccggatcgccgccgaggggaggctgcccggcagggagggagccccctggccggcgggagcggccgggcaggcggcgcggggggcgagcctccagccgcaggaggagccggggtgcctgcgcccggccctgcgcgccccctcctctcggccgggagggcggggagggagtttcccacgtccaaactttccccggcgcggagccgagccgcctctcggcccgaagcccgcagctcccacccgtccccacaacctcgtccgccgcgcgcccgggagcctccgggacccccgcgggccgaggggtggcagcgccaggggccgagccggcgcgccaaaaggggctgggaaggtggcgcacagccctgacgcgagggctgggacccaggcgttcccggtcccccaaccctgctagcggggctcggctccccggcccctcccagaggcggggtccggggccgggaaaataccgcacggcgcgagcgtgtgcgcgcggtgtgtgtgtgcgaggtcgtgccgcgtccggggacacccggaggctgactccagccgcggcgacacgcacggttctggtcccctctgagccggggaggcggcccacagggacccctgccggccccaccggcgcgaccccccctgccctatggccgtcgggcgggctggcggtgggcgagggccagcgctgctctcttccttaggacccgactccggagacaccgtccccgctggggaagaaggacggggcccccgacagcctaacgtccaaagagagcgccacttagggctaaccctcgggggccgcggcgtttactgtgaagagtggactgcgtgggcgcgcggggtgccgggcagccctgggtgggcacagtgtggacccgtctcgctcgcgcctccccgctgcctcttctctggcaacgtcgggccctgtcccaggcggggctgcagagggtagggctgatccaggatcccccgaggtctccccgaggtgcagggcacccccttgtggcgggcagagaagctgctgtttgaagctgctcaggtcttccgaggtgctcgctccttggaacctcttctctccaaacccttcgggcgtcgccagggttgcgcatgccagcttctttttccgtggggctgattccagcactccccaggtttctggggctggccgaggtgcccccagcacaggcagcggctcatttgagggctttggctgttgccagctctctctccctctccacccaggttcaggatctcatcctcttctcccactggtcagcgccaataccctatatcagcatcaccactgccctagggcccaaaggctcctccctaaccaccgcgactctctgtccttcatttgtatcccgtatatgtgtccatcagtgcccactccgtccccctcagttgcccctagtctacagcccttgttgaaacttggcctctacacccatagtgacatcctttggtctttgcccaccaatgaccatttcctcgtcccccccaaccccgacccatcttctatcctgtctgcctcagtttttctgtagcactcaactgttccctgccccagccatttctctacttcacccttatttccctccttgtcccagtgtctgggacactcctcttccattcctcctggaagggaagggcattgccaacatttaaacactgcttcctggagatgtctgtgtgcccttcccggtccaccactgccagtgcctcgggggcaggtactttataaagccagccaggtctctctcagctaaggggcacctgtacctcttgggtggccccatcaggggacccctggagacaacccctttccctattcctaactgtgagcagcacattggagaccacctgggctgccctcttttccattttcaaggattggcaacagcagcccgaggtcacatggtaagctatacccagagccggaataggaacccaggcatcttgacatccaggcctcaccaacgctgcttatgtgttgggtaggcctggggcaaaacagagccgtttcttggcttcacgctgcaggcaggacaagaagacacttgctctaaattcagcatgaggtgttcaagttagacccccagtgctcccaggccagtgccggaggaaagctgttgaatgcctttagcagagacgccgagtagcagaagcagaggacaaagtttggcccctaaaagtgtgttgtgacctccgggtgagtcacagcctttctgtcaaaagggtggctgtgatctctggatgtttctggtcgtgctctggaataatcatacctagaggttggaacccccaaagcccctgctgcttccccaggcactggtctttctgagagctttgcaggagcgctgcattctgaagttgtctgacagggggccgggccatagctaaggcagggagcccaggagggcccgtctcctcccgagttggcaaagttcggagcagccagtttatttaccacatgggcgataagagtcagccaattaaacttcctctcctctctctctctgttcttccccctcccctttttcttccatcaggaagctccaatctgaaatgcagcctcaggtagagtgagagagagtgaatgatttctgtttatataacacgggtagcagctggcactgcatggcctgggagggagtgagggaatagaagaccctacggtggtgtctgggctgaggccccggggccaaggacttcctcattcctccccatagctgagccaggaagggtgctaggggctggggaccaggtggggaaacaggctgagaggaaacccaggcctcaggtcaggctcagagagaaaagcctcatgccccccgcaagagtgggcacaccctccaccccgggttcctcaaagcacctttaagatggagctctcaactcaggcctctccttcctacaaccttgtgttttgattctggcctctctagagaaagcctagatatttcaccacgaggacaggctctgacctcaacttttcatcagggcagtgggcatgataggactgtctttccgcccatggaggagacaaggcctaacaagaaagttgtctgtggagtgatttgagctctgtgtatctggcaggagggacgttttctcattgttgatgatacacagtggctgcttggaaacagaggtgcaggacaggaaggctggaggcatggctgttatatgcagttgggcaggttgttgactgtccaagggcatttaatgcaggaggagagcggggactgaaatctattttaagctccactctccaagtcaggtgccccaaagacaggctgtgcctgcctggaggagggggcatctttctctaatttgcaaaaaggcttcatatacttaccagccatgggcctatggggctgcttacccccagaaaaggatccctttctttaattactccaaaggtggcccatctgggggttaaggatatattcactactcactccttagctcagctctcttacaatgggcacacacctttccgaatatgtgggtctgatttcaaacacatgaggtacagcaacctggaggaattcccttcttcccccacatttccctccatgccccatcagcaggctccttcctgctgtcacattgggattaggctgggaacttcttgctttgtcgtcagacccacaagccttcagccatccacttgttaccagctctttcctgtgcataatataaatagatgattaagcgcgtaggcattggagtccaaccagcctgagtttgtgacttgctggcaagttactttacctctctgagccttagtttcttcctctgtgaaatggaggaaaatgtaatacctgtctcattgggttgtgaagatcaaatgtgcatgagcatgtatggtgctgagcacaatgcctggcacataggacaccccatacataaagcagtattgttattgctcatatccctccatttatattccttggttcccatggggtaaatgcagcagttcctccttgtttggttttgcacatgatctcagctgcctgcacccctgcaggaggggaattgagttaggaccaccaggatctgtctctgacttcaggatccgtctctgacttcaggatccttcttcctttgccttgaggaaggtggagtccctgcatgcagccggcagtgtgggaacatgttctagagtcccacagattcatttcatcctaatctctaccttttctcccctctcatccatctcgcgatcccttctccagctcagacctcactggttcatgcctaacctgttgtggcagcctcctccctggtctcccagcctctgataccctcccgctgcaacccctgcggcaaccagagcgatcgttctctaacgcaggtgggatcgtgtcactggcttgattaaaacccttccatggctccccattgcctactgaattaagtccagactcggcactatgacattcaaggtccttgtaatccgtctgcatcctcctttatctcccactgtgcctccaatctgacactcctgcatccagccccacctgcccttccacctgaacaaccttccccgaagatattccaaagcattaaggacccaacccaaatagcacctcttccttgcatcacccatctgcctgtctgaccatacattcattatccagtttaaaatgtatatatatatatttacatataaagcatttacatatatttacatataaagcattactatgtgttaagcattgtgctgcatggtggagacacaatggtgagcaagcagcctgaatcccagctgacaggagtctggtggtccagggaggaagatgaacaattctcataactgtgacagccagtgggcggggcagcagaggcttctaggaggaagtgctgttgaggcacacctgcaggctgtctcgcagttatctatgggataaaggagggtagggaggaataagagcagagaaggcagcctccatgccaaggggtaccaaggccccaaggggagggagaatagcagaggaactgagatttcagttggctgaaggagaacacacagaggttggggttcagggagtgggagtcatgggaaaccaggccagcgaggtgggcagcagccaggtcccgtgggtcttgaaagccacacaaggagcttggccttcatcccgagagcagcggggagccacgcacaggttttcagcaggggagtggcgcgtggagattcgccattagaagcctcatcctgctgctgggtggggaagaccaggtcccgggctgctggtgtctgggtctgaggcatggagggggactcacttgtgagggctgtgggagtggaatggacagggctaagtaactgcctgggcatgggggagagaaggagttcccattcctggctcgggaggctgtgtgggttgtgaagatgcgaaatgaagaggagaagggctttcaagaagaggtgaggaccagctgtggacaggtcgagggtgagatcctaatgggatacatgagtggggatgctggatggatagtcatgcaaaaacatctaggcccactcagagagttctgggctggaaatagagttttgaggccatgaggaaggaggagctcaccatccaggatgagtctgtaaaatggaaagaatcttgaggcgctctcaaggttcggggacggggttcatccccagaagccttcttggacccagccaggcacacgtgactcctgtctatattttgaacctctgtagcaattagtttagttttcttttctcactgcctgccttgtgtcatctgcagcacattagatcagtgtttttcaactgggggcaattttgccccccagaggactcttggcaatgtctcgagacatttttggctgtcactactgcgtagaaggctgctgctgtcatctgatgggtagaggccagggatgctgccaaaccgcctacaacgcacaagacagtcccccccaccccactgcaaagactcatgtagctcaaactgttgatagtgtggaggctgagaaaccaagccctgtatgagaagatcttgaaggcaggcactgggctttttcattttttcctccctagggtctagcgtggcatatggtgcaaagctgcactcactccattcactgaattaaatttgggtgtgaggagagggggcctgaggccatgcagccttgaagtctgcaagactaaggcccaactctgaccagggttgcctggcccctccccagagagctggaccatgctaatacacaggcacttagagaggagagaaggatgcacccgctggtggggacctcctgtccaggagcccagaagttgagggcacattgccatgtatagttcaccagcctcattctttcgttgtcttattaacttctgttgtttctttatcactcaagtcgatataatatatatactatatatatatttgagacggagtttcactcttgttgcccaagctggagtgcaagggcgcaatctcggttcactgcaacttctgcctcccgggttcaagcaattctcctccctcagcctcccgagtagctgggattacaggtgcccaccacaacacccggccaatttttgtatttttagtagagacagagtttcaccgtgttggccaggctggtctcgagctcctgacctctggtggtccaccctccttggcctcccaaagtgctgggattacaggcatgagccaccgcacccagccatatatatacatatatatatatatttttttaataggcaagttacagataaacaaaatgagaaaatgagaaacatgacaacctactgattaggtgcatgggctctggagccagacagagcagagttgaagttccagctctgccacttaatagctgagtgagcctctgtttcctcatctagaaaatggttgtaacaaaacctacctccaaggactggagaaatgaagtaatacagacaaagcgcttaacactgcacggggctcatatgaagtatttaatacagagtgattctctctctgtgtgtgtgtgtatgtgtgtgtgtgtaaatttatatatatgtatatatgtatgtacctttttatatatgaaagcatttttaattagccataattttaccaccacttggctaccatttcagtgcatatccttcttgacatatatagatttttaaaaaataaaaatggcatcttgctttatacatatgcctccgtaacctgctttttttcaccctataatatattgtgaatgtcttgccatttcgataaatatacatctacatcatcatttttcaagagctgcatggttctccattgtgtggctgcccataattcatttaaccagcccccactgttggacatttgggttgtttccagtccttcgctattacaaacaattctgccatgaacatccttgtacacacatcttcacgctcttgtccgatgatttcttcagggaccactgggacgtttttggcaggagtcgtgtggcgctcaccagattcctcaagtagaagccccttggggccagcgaagaggggactggggggtccctggggaagggaaggatgctggatggcagagaactgttttggcctctggaaagttggtccagatgttaacaccacagacccctctgcgagtcaaaaaagcagaaagccccgccccatattctttgttgtcaccgtagtgcttgcagagtaggggaggggagctggggaggtggagtgtgtgtgtatgtgtgtgtgcacgcgcacgcacacgcgcgcttgtgtgtgtgatgggcagagtgacaggcaccaggcaggcgggggacataaggtggatgggcccgggcaggctgatggatgggaagcagaagcaggtggatccaggtcagtgggtagacaagatgatgggtaggtgacaagccagacagactcaggtaaccagacataggactgtggcctcacagcggggcccacagggaccagaggctgaaattgtgtattcagggacaacagagagttcctgggagaggcagcccaccccccaggccaggaggttgccaaggcctgcgtcttctaggatccaagtggctgtgtttagggttatgcattttggagttgaaagggcctttagggactgacgagtccaagtccttgatacagaagggaaactgaggcccagggagaggctggaacttgcccagggccctatggtgtctcagagcagactgaatcctttgcccctagctcagtctatttcagtgtccatttattcaaatggcttgaagagaagggagttaagttggcagagtgggagggggctgggaggtcagaatgagccttgtcatgacttttctctgtccaccccactccaacagcgctatttatgaccctactgtgtgctgttgagagaactgcctaggagccagactaccagggttcccatctttgccctgccacttactagctgagtgaacttctgcctcagtttcctcatctgtacctatctcataggattattgagaaggcgaaatgaattattagaagtaaagcacttagaacagtgcacttaggcccatattcagtgctctatgagccctagctactaatactgtgctattttgcccttattattattattattttaatttttttttgagacggagtctcgcacaggcgtgagccactgtgcccttattgttttcccttgaattctgtatatgtttgtacgcacctgcgtgctcacacaaacgtgactacatgagcaggctgtgtaccttggaaggcaaaggttgtgtctctcctgtgtcctagccctcccaccatcaggaccctattagccagctgggcacatagtaggtgctccataaatgctcttgaggaagtgatgcgcttgactctgtctggtcgaaggcactgggggaggcttcgtgggggaggcagtatttgagctgtgtgttgaagctaggatgacgctgctgcaggtggaggtgttttctgcaggtggaaagagcatgagcaaagaggaggagcttggcaaaggcttcggtgtcagctggttgccccgttgaccagggcacagaggacatggaggggaggaaagacagagaggaccagaaagggaaggtgcagctgaattcagatgcgtggagctccaggctgaggaatgtaagcagtaggaagctattgaaggttgctggctggaattaagctgtagaaagatcttgctgttgacagtgttttaggatggacttgaaggaaagagaaaggaggcaacagacggggacagctgaaattgtccaggagataagtggggtgggggcttaatgaagttgtagagaacaggggccagggagaaaggccccaaggaaataggatcaacaggactcagagctgcttggttgtgggagataagggagagggtggaatgaaatatgacaaagtctcaggcctggtgtctgggagaactggggtccattaaccaaattaggggagcctatgcttgggagaggcaggggaaaattgagatgccagctgagattattcatccagccagcatcccatctaagccagccatccatccactcatccatccacccacccatccatccatccatccatccacccattcatcaatccatccatttatccaatccatcatcctccagcccacccacctccatttaaacatccatctgcctgcagttcacccctcacccacctccacccatctatccaccaacccgttatttacctacacgtgtatcaccacctttctttccgtcttcttactacctgtctctccaccctcattcaccctcagaatctaccaacttctccatccatccaagatacatttcttgtgagcctactatgtgccaggctctgataaaaccttaacacagcatttgaagatacctgatactaaagataatgattagaaaagccaaggaaaagaaccagaatgattttacctagaagagagaagtttgagaggagactttatgtatccaaagtgaagaagaatggaatgaacagtggcctgtagatgagcctttttttttctatttccaggacagaacagaagaaattggctgcacttgcagctagacagattgaggttggctgtgagggaggacaaccttattgatcattacaggtgtctgaagtaccgatctgataatgcatttgggctgtagggggatatcatctatagaggtgactttgaggaaatgggtgcagagtgggacatttgtggaggagttagtagagggggcgtcgggatcttgccttgagaagaggtgggtagggggagtggtggagcagaggacgaaggtgaggggaccatcaggggcacagggctgtgtaagccaaggagacaagcctgtggctaggatgggtcagctgaggtagggcacctgggtagtgggtcagggaggagatggctgcatttaatccccaaaacaaccttggaggaagggccttcccactgtctcactgccactgtcccttcataagccaccatttctctccaagccctcatcctcttggaaagccccgagcccctcccagaacccctgtccccagcatgttagcccccatcccctcactgagcccgcactctcttttctgagcctttgtgctcacaaaccccagccctgcagctgagcccctggccagatccccacctcccacagagcgcccgtctcttcttggagtccccatctccttgtggaggcctggtcctctctcaagatagagcccccaattccccagaatctccacagagctcctgcaccccctgtgaaagctctaaccctccacggagccccccacccttcctggagacccatcccatccctgagcccccgttccatccctgagcacctcctgttacttagctcctggtcaccttctggaatgcctgccccttccagagcccctgttctcccacagaatttctgtcccctgaactgaagactcatctcctctctgagcctgcattccctcaaggagcccgcatccctactcacagagccctgacctcctcactcagcccctgcccctcctggagcccttgagcagcccctggcttcgagccctcatgccaccctctgtcccagggtaccagcccttgatgtccgcggggcacaatcagccagcagtgggtggccccagcttaaagtcactcccaggtctctgcatcaactcagccagcttcaggctgggaaagaagcccctggatttgggaccataagaccctccccgcagcctgcctagtaccatgggtgggcttttaggacagagggacttgtaagtccccaagtgggctgggctgggggtggagacctgcagctttggcagctccatcaggctcgtcttacgggctgggagaagctggagactcttgctgcttctggttagaaaaacaatcacaaattagagaaaatgctttgggaaattgctctgctgtgcgagagggaggctgcctcaggagggagggaaagaggctcctaagacagcagtggctccctgtggccttgcctgtcagcgccaaaccatctgcttggcgttcaaagccccaactcatcatctgacatggtcacctgatgagctcagacacatacccgctaggccattgctccagggcccattcccacctgcaaacctttgctcacctgggctgagccctcacatctattcaatctcagtgccctgtttcagccctttgcgaaccattgttacctgtcttgcctctctaactggtccattgaggacaggaataatgtcttttgctaatggcagtcagagacaggcagatctgggcaccaatccctgttggatacattttagctggatggccttgggcaagtgtttgactttctgagcctctgtttactcatctgtaaaatgaggagtgtaagacctcccttgctggaatgaacgagataatgagcaaatagtgtcctcacagtgggtaccaaattaatgaagatgcccctccctgccttacagccagatcaggacttcgggctgtgagaaccagcactgatctacagacgtccacttattggtaacatcctcaggtgcctcttctcttatatctgtctgccactcccctactgcgaagatacaaaaagagggcccaggagtttcaggacaagcacctgggaggctcctgatataaaaagatgaggcaacaggcccggcatggtggttcccacctgtgatcccagcactttgagaggccgaggcaggaggatcacttgaggccaggagtttcagacaagcctgggcaacatagcaagacccccatctctacaaaaattaaaaaattagccaagagtggcagcacacgactgtaatcccagttacttcagaggctgagataggaggatcgcttgagccctggagtttgaagctgtggtgagctatgatcatgccactgcactccagcctgggtgacagagcgagaccctgcctctacaaataaatagatgaggcaacaaaagttgaatttttgagtcttttgactatcaggcaagacttaagctggatcatcacctatcaggaggaatgaggatggcagcccagagcttggattctggaagctggacttggattttggaagctggacttcctgggttctgctccctgagctgccccccttcctagctgcctgtccttacacaagttacttaaccacctcagtttccccatctgtaaagtggagatgataatcacagtagctgcgttacaggcttgtggtgagaatgaaacaagctaatgtttgtaaagtacttagaacagtgcctagcattcataagccctatgtaagggtttctttaaaagtaaatgtgatgagggattcgggaacacaggagtggacagcggagagctcaggctgggtagcaaatgggctttcaggagggagttctgcagagctagagtccagccagcttcctgtcaagttggcctctttctgaatagggagagcacaggatattctcaaagcaaaaacattttttctggagaccactggggtgcctcatttggagaagtctgggccaaaggacgttgcatggagaggcggcctctgcagagggcagcagggaaagacatccagggctctcagagacaccccagaacctcacagatctcacctgccagtgagaggctcctcgcatgcctgttctcttcctggcagtgaaagacaaggccaattgtgtgtgcccttcgtggaagaggtctcggagaattctctccctccagacagtgagcagagaatgaagggtgtgaagaagaaacccctcctcagccacaggcagctctggaacaagccctgttactgtctgccgggtgccaggcctgtgctgggcaccgggaaggtgcagtgggtcagatatgttcttgcccttgaagaatttgggatgaacagccaatgccaggaatcccacttctcctagtgcctcagttttttcagttgtcctcttcccttctacagagtagccttttccttgcccctttctttccctctttctcccaagcccccacctacccaccccagcagaggttggggggagccctgtggagaagggagagtttgtacaaactggggcacagttggaacttctgattggctggtcagggccattcttttccctggttgccatagcagccatttcccggggttgtcagtgatgaaactcataaacattgttttcaaataatccgtgtaattgaaataacaattgagctgttaacttgtctctcacaccccagctaggacagatcttcctctttccgcaccctcctaccacccctgggaagctctggtgtgtccccatctcctgtctgaggccccagccccttccttggggcaggaggaagaaagaggaggttgcatggctcctcagcatcattatagaatcctagaaactcaggaccccacagctgaaccagaacttagagaacagaacccacttcgtttgcaaccagagactcaaggaagggaaggggcttaactagggctccacaggaaggacgcagctgaatgaggacatccagtcctgcttttaggtgaaggttgaagctgatgtgttgcactgaggatcaatgcataaaccataaagctgcccccttttaaggatttggtcttgcaggcatatctacctacccctacccccattttacaagtgaagaaactgagactccaataagttaaacataatataagtgtttttttgttttgagatggagcctcgctctgtcgcccaggctggagtgcagtggtgcagtctcggctcactgcaacctccgcctcccaggttcaagcaattctcctgcctcagcctcctgagtagctgggattacaggcatgagccaccatggctggctaattttttgtattttagtagagatggggtttcaccatgttggccaggctggtctcaaactcctgacctcgtgatacgcccgccttggccttcgaaagtgctgggattacaggcatgagccaccgcacctggcctctgtgtttttatagcttctcagaaaatacctgttgaatggatggatctcaaagaacacagaccacctctctcctccccacccccaaaaccaggaactgagatctggtttctttagtcagaggacttcgtggaatagggttgtggacaatttggggacatgtggctcagaggaagagtggattcctcaaacgactattagagggagggaattccaaagttctccccctacccccagccacccctatcttgggtcggagactgcacattcagaaacataaacatgaaaaacataggttccctgcctgatcctcagaaaggcctgggatggattgaaaaatggaagaagcaaggcctcttctacaagcacatgtctccatgcacacacggagatgcaggtcagcacagacagctccctgtagcggcagcttcatggaggataaaagcattttttataaagtgtctggttgctgtccaaggtactctctgagtccacagaatgtgtgggtggctgaggcaacaggccattgctaggactggggatgggggcagtcttcagaccagatgacagcaagaggttggcctccttccctggattctagagggttgtaaccactaaggggtcttggcagtctcctcccccaattcattcattcttacttactcaacatatactgagcatctactctgtgccaggcactgtgtggaccacaaaaacattaggattaggaagacccaggatctgtctgcaaggactctttcagtctagtggggaagacacacatacacacacacacacacacacacacacacacacacaaccagtggctggtgctcttctagaagcaccagaacagaacaaaagagggagtgattaactctgcctgcaggaatcagaaagaccccctggagcaaatgacttgggctcagtcttaaaaagatgaatagttctccaggtggataatgggcaggagagcatttcagaggggcagcatgaaccaacgcagggaagaattcacggtttagatcacaatgagaagttctgtgtgactggagtgttggctgcttgaaggtgaatggcagattgaggagagtgggttctggagaggggcagtgacttgcccaagatgccactttgagttgcaggcacagccaggactaagacaccggataccctaatttgtcagaaaatcagaacatcagagttagttgggcgtttgcgattctctaatccaaactgcccatttttcagatggggaaacagagggtgagagatgttcagtgctgtgcctggagtcccacagtatgggtgtggcagagctaggatttgaaatctggtctgtttgacatcaaagccacagctgttttcctagtgccacagctaggagcagagcgaaccccacctcagctcagctggagagcagagggctctgaaaaggacgggctgctcatgggacctttgcatttattgggacaggcagccagctcctgccatatcgttggcactcaacactcaccctgggggagggagcctccagtgggaaagctcagcaggcatgccttcctgttggctggagagacctaagtcctaccaccaactctctgagtgaccttgggtaaggtgtgaccctctctggtcctttcttccatgatccactatgtcataggaggatcctcctttgcctactgtctggagcagtcattctccattggggtgggagagcagttgattttggcctccagggaacatttggcattgtctagaggacaattttggttgtcacaactgggaataaagagtgctactggtattcaatgggtagaggccaagaatacggccagccatcctaccctgcacaggacagcccccaccaacaaagggttatccagccaaaatgtcactgctgctgaggctgagaaaccctgaagtctgaggccatttgtgaagatcagatatggccacaagagtgggcacatggggctgtgcagaggtgcaccccaggctgcaacgcagaggagcagaagtggccttgctgtcaggcagacctggctgtgttgagaggtcgttcacctctctgtgccttggttacttcatcagtgcagcaggggccgtaacaagagcacctatctcgggagactattgagagggtgtgatgagatcatgaatgtcgacggcagaggaagcaaatggaaaacagaagcctggagccagctctggagccagcagggccgctcagggctatgggatcttatgcaacttacctgacccctttgcctccatttccaatctgtaaaacggggattatggtagtacccatcacacaggctcaatggaggattaaaaatgagttaacagatgtaaagcatttagagcgacacagagtaagtgcgatgcaagtgttagctattattatttggttttgtttgttttttgttttatttatttatttatttatttttgagatggaatctcgctctgtctcccaggctggagtgcagtggcgcgatctctgctcactgcaacctctgcctcccaggttcaagtgattcccctacctcagcctcctgagtagctgggattacaggcacatgccaccacatccagctaatttttgtatttttagtagagacagggtttcgccatgttggccaggctggtctcgaactcctgacctcaggtgatccacctgcctctcttcccacagtgctgggattacaggagtgagccaccatgcccagccagctgttattatttgaattctgtcttgaacaaggcagtcacataagttgcagagggtgcattggacaccaggccctccagatgccaactctctctgcagctctctgactatccatgccacacccccagccttccttccaaacacaccccccatagaccctgcttgggctctctgcaactctgcaaaactattactctctctctctctttcaccagctcccaccctgcttgtctctagcttcgtgaattccctgacacattgggctggccctctcctccttctccctccccatctccaccctaacccccttcctctcccttagagtctgccagagccagagttagctgtcagcagctccatccaggaggagggggacacaagggtgcccacacctgactctatagctcaggcccgcatcgcactagccctccccctaaacactcatatcctgactcctggcccacttggattagccttggctaacccttcagagaatgaataaatcctccagtgctgggtttctcaacctcagctctattgacatttggggctggataattctttgtcgtggagggctgtcccgggcattgtagaatgtttagcagcattcctggcctctacccactagatgccagcagcaccctcccacccagttgtgacaaccagaaacatctctagtcattgctaaatgtcccctgggtggcaaaattgcccctggtggagaaaaactgttcaagaacttgactatatattgtgagcttctgtctcatagtgtcctggcaaagaagctttgaaaatctaataaatatcctcaagttgagcccctcaagttgatgccaccttcaactttgtacagttttctcaccaaagttttcatttcttgacccattctcaaaaccagttgaccacaaacattaggcccagctcccaaacactcagctctaactagaattctgaatattaactttaaatccaaagcttcaacctgttttccaaactccaaaccttaattcagaccctaaccctaaactcttggcctgttctaaaactttagtttcctgaacttccaacagaattctaaatccacaggttagcctcaaacatgaagccaagttggaaacctgcacttccagatccttccatcaccagctcctaaattttaatctctatcccttctggcctctagagattccttggctcatgtttctagcttcctcccctcccaggtgaccccaggtccttcagaaatggcaggaaaatttccagtaggcagctctgtctagccataatccctccctcatatcgccccaggcaatccatctggaaattctattattattcatttgtttattcaaacatttgatgagcacccactctgcagactctgtgttggacaccaggaaagcagtggagaatcggatccagtggcttcccgctgtctgctgggggagacagacaagcagacaaacaggaagacagatagataaaaactatgcgagtcattcaagaaatatccactgagcacctattatgtgccatgcgctgttctaaatgctgggaatacagcatcaagcaaaaaagacaacacccctaaaatcatggcactcacattatagagaaaggaggcatccatttataatatatcagatagtgataagtgttatggagaaggtgaagaaagcaggatgaggggatatgaatggcctggggaactgaggagctagtttatcacaggttgtaagggaaaggtgcatggggtcagccatttgagcagaccctcgaaggaagggagagagtgagccaggcagacatcaggggcgagggtgttccaggcaagaggaccagcaagtgcaaaggcccaaaggtgggatcatacctggtctattcagagaagagccagagggccagtgtggctgaaatagagggagaggggagtaggaaaaggtcagagaagtaacaagaagccaattcttgttggatcttatgagccattttactccgagtaagacaagaagccaaaagaattttgagagaaggagtgttacggcctgatttatgttttaacaccataactgagaacagtctgcagggggccagggcagaagcagggataccagttaggaggctgttgcaatcatccaggtgagagatgatggtggccggaccaggctgctaacaatgaaggtggcaagatcggccagattctggatctattttaaggtagagctggcaagatttgctgatggattggatgtggggtgtgaagtcaagactgacttcaaggcttttggcggaagcagctggaagcatggagttgccagttaccgaactggggaatgctggaagaggagcagtttttgaatttatgttctcattatttgtgtgtggttgggggtaggactcaggagtccgggttcagacatgagggttttgaagggcgttttagatatctgcactgaacaggcaagaggctctatgtgttgggttttgggcagacatctgagttggacacacatatttgggtgtcatcagcaaatccatggggtttcaagctgcggggttacatgtggtcatctgaggaggagtggcccagggactaccctctggggccttcgaaaacttggagggaaatgagatggaaacagcagaggaaactgaaggagccaagagctctatgaggtacagggtgctgggagaggtgtggacacataggggagagagaccaaatctggggtaccagggagggattcatatattggaggggatattggagcctggctttgagtgattcatacaaaatcccccatcagacaagattggggaaggacattctccctggaacagtacatgcaagggctcacaggcctccacacattggggaatgttaagctacataaatggttccttatcctccaaacttgctacttccctctcttccccaaatctgtgaatggggccacctcaaggtcttaccgaacaggtcctcatcttgcagctccccgtagcattcctactatatcccgaggattctgccttccgtatgtctctagaaatagcccactcctctccaacctcactgcccccacctacttcaagccaccattattgttcacctggacaacatcctcctctcccatgtccgtgtttcattctcagccacctgatgggggaccccagcaggtgaaggggcgggggccagtctgcttcacacccacagtagcctgggtgagttccaaacagaataagattcatgccaatcctctgcttcggaagctttcaatagcttcccattgctcttagaatgaaatctaaaatttaacaaggcccacgagatcctgcacggtgtggcctcctgcctgcttctcctgtctcatctcggccttcttccccattgctcctgacgtgccaacctccccgctgcctttcaggttctcagcttggcaaaatccatccagcctcagggcctctacccaggctgttccctccacctggctgccctcgccctcgccacccccacactccagtctgagaacaaatcactttctcagggaccccttcccaagagccccagactagtccgagctccctgtcagatgctctccttgtacctttcttttatagtcatcatcgcatgttttaatgaagtcgtgagttaataatgataataacagctaacacttacggagtacttcttactccatagtaaatgatcagaggaatattgagtgattcacatatctttttagctatttaagtcctgacaccaccgtgtgaggtagctactgttattattcccattctacagaggaggaaactgaggcccagaagaggttattcatgcaaggttacacagatgataaagagctaaactgacacagacctaacgtctgtcttttctgcttgatattaaattccatgggatgacggaccatgcccgtcttgttcacagcttcatcccctctatccctcagagggcttagtaaatgtttattgaataaatggatgattgattgaatggatgaataaatgaataagagtttgagcagcacaggactccatggtattggaatgcaagaaaggaggctggagccacagaaaggaagagacatgaaggaccctgaatggcagacagatgagtctggaattgggtctgggccacaggagccatagggctttctagagcagaggagggcagagctcagataaggatgttagacagatatagcagctggctgccacggaggaagaccagaggtggggtccttccccgcccagcaaccaggcaaggctggcacccaccccctctcactcagccctattagcattctgcatgtggctgggctccacaattaacacaaaggtacagtcattcattctgactggtagactcgggggatcggcggatcgggggctggctgcgcagggtttctgctgggaaggcatgtcacagcacagcggccactgaaatgaaaagctattaataatgatcctggaacttcactcccatcagctgtttgtttaaaggtgttccatacttggagctgcctgatttatgtgggcaataacgcgccctggtcggtccgcactttttaaagcagcgctaatggggtgagactgagaccccgggggatgctggggaataaggcttgagggccaggcgtggtcagatttggacctcgactccctgcccagcatcagagtgggagagctgaaagagccaggcagctgggttcaaatccagcttgagcatgtccctttccctctctgagcccccgtttcctcatcttctctttgagtaagagaacacctgccttccagggttgacaggaagatcccatgaaaagcatacagtaagtgctccataatgtcttagttttctcccctttctcttttccttgtagaaaaactctccccaccacctgccagccctctccaggaaggagaagcattcaatccacttaaatgtttatcgagaatctacaattgtatttgacatttaaattcctgaaggcctgacaaaaatgctgggacagacagcctgtcgtgcccattttagagattaggaaactaaggctcagaggaggaagagacatgcctaaggtcacccagctcaaaatccactacatgggagtcccaaacgggcagagattgtatatattttaatccaccactgagtacccagcaccttgtccaatgcctggtatgtcacaggagcacaatgtatatgtgtcaaattgaaaacaaaaggtgtctgaaccctgaatcttgcctcagaggtccaattccctttccatcatttaatctcagtggtagaaacagtcaggagacctggattctatccccaactctgaggtaagttgcttaaagggaacgttggatcagatgaccgcagggcagtttcttaacatcagcactactgatatcttaggtttgataattattttgtgtatgggtgtttggggggaaggtgtcctgggcactttggaatgtttagcaacattcctgccctccacccactagatgccagtagcagcctctcagttgtgacaagcgaagatgtctccagacgttgcaaatgtcccaagggtcgcaaggtcccccctggttgagaagcactgcactaggggctttctccaaacacacaaattctgcacagcagaggtctacattgtggtgggggagtgggggagacttggcctgtgacccaggaaaaatgtcatgttgacattttcacaaagtctcgttttcccatttggcctgttcgagaacaattctcctttggcagagccaatcaccaggcagttctgctaacaatgctgcaacctggtccacagaccggatggtcacggcacatgcaaaggcaagcttcccagaatgcagctaaacatgggaaccaatgagtccccaccaggtacaggggcgaaagagaagtctggggctgttggggatgaatgaagaccaggagtgatcagcactgggtacagtggtcaggttgggggtcgggggaaagcctgagcagagatggagaggcaggaatgagtgctgatgaggagtgagggaaaaatgatctgtgcccatcccagaaggacaaacacctttcagactttccctcccattttcccacctagtaaagctgcactatctcggcaggagacagtttctcctggctccaagtcatcccctccatgcctccttcccactgggactccttacacagaggcggcctggagggacagaaatggcgtgctttggtgtcagacaccatgggttccagtttcagatgggaatctacagccctgtggccttggctcacatgacaaagagaaatattaaaaatactgagccactggaccagcatactcactgatcaatcagaacaggtgacagttgaaaacaactgacagggctagctgaacatcggccccacctctgagtctgcacctccacctctgtacatctacctcctggggctgtcaggtgaaatggagagaaagcacccagcacagcagcttgcatacagcagggattcaataaatgttccttggcttcccccaaagatcccagaaggtgttgaggtctgaattttctgcagtgggtccctgcaaagacatcattctttccagatgttgaggaaagttgtgaaccgcttcttccagccagggcttaggagcagggaggctgagaacgatggtctgggtgcaaagacgaactgcaatcagggttcactgatcacctttgtccccctggtggtctttgtcctgcccagggactctggcacaccttcctgtcatgcactccaggaagatctgggtctgtgcgtcagacccgggccagccagccccctctcggtgtgtataggcagcttgtcactacaaaatccattttcttatctcctgccatatctatttttctaattcttacttaacgagctcccctgaaaataagaaaatcattggaacaatttccttaagtgtgaaagattagtctgaaattggcattaaggggactaattaccttcattctcccacctttccgacagccgtttgttagctgtgaggactcattcatctgctgctcagggaagtcaggcaacatttggctgtggtgggatcctccgctcctgctttggctcacggggtgtgtgtatgcgtgtggtgtgtgtgcatatgtgtgtgtgtgagacagaaacagagaaatggattggggagcagaaaagtgcagaaaggcccgggactccatgtgaagctgctctctgggactctttggtgatggcggtgggggtggggagggtagacatccaactcagaatcaggggtgggtggatacctggggaggtgctggcatgagccagacacacatggtctgccaagctcctagaggtctggattccctgccgctgactcactgaatgactatggggaagtctctgtgactgcaggcctcagttttctcatctgtaaaatgagggtcatttcttgtaactacggtaatgacagcaatatccagcttccatggagggcaggcatcgcatagtgattccaccccctcttcatcctcaccatagccccgggggcagttcctatcattactgcagtgtacggatgggaaagtggaagaccagagatgttagggaacgtgtcccaggtcacgcagctggaatcggaatctgagtctgtgtaattctggagctcatgtcctgtccactctactcagactccagacctccccctgctcccagaatgcattcccagtgcacttggaggctgaagacataggttccaaccccaactcgagcttgcaccacttgtgtgaccagaggtacatccaggcatctcctctgtaaaatggagacagttatgcttcttgccataactggatgtggggggcaccccatgccgtactgcatgctgtaaacaaaaatgaaaggatgtggaagcaaaggatggcagtggaggagggccaggaagaggcgagagctgcacagagtctgtggaagccctgggccatgaacctgggtctctggactccaggctcccctagacctggccagctgctcccactcctgtccctagctttgaagagcccgccttcctgaacaaagctctgagcagcaaggaggcttgtgacgagggagcaagttgacaaatggtgacgcccagaattaggcagggattacgggttccagcgtccaggcctgcacctggtatgggggaggggcaatcacccacccacccttccctcccccgggggagaactcactgggggaggcggataagctctgagaagacgacgggaacatcttccattttccatttaaccacccgatattgaattataaataattcatacacctgccaaacatttgattaaaagaacccaattcgcactgcatttgtcaaggggtaagaattgcatttggtgtttttattttaatctgtcctttaactcttttacgaatatttatttacacttggctgtcaggttttattctatttgccctgattttattctggctgtagctggcattttttccttaccctttttattttgtcacttctgcctagtagtcatgcatttgagagcccagaggtaataaataaggaagcgagactccttcctgctctctcagggcacttggccccatgcatctccacccactgtgtgtagagacccctttctccccagtgctgctcccaccccccgggcaaatctactgtggaatctaacctgccaaactcagggtatcctgggcacgttgtattcatttctgtctctggatctttgtctatcctgttctaccaccattctcttccctctttgccaaccatggtgcaggcactcaataattattttttcaatgaataaatgaagcatgatcatcagactcatcagtatcggtatctttggggacaaaaaggaaggtattcgtattcaagtctagtgataggagaaagctgtcatagtggaccttagatccagctcctgctctgccagctgtgtgaatttcggtaagatactttcattccctaagctctgcattctgtcatctgtaaaaggcatctgtaatagtagcacccgcatcagacattgatataagaattaatgcgtgtgctccgcacatagtaagcattcaaaagccaggagctgtgatttttatgatgaactgtaaactcctttctcatatcctgtccatattcctgcctttcccttgaatctgaaggtctgggcatctgtgatattatcctgaatgccaggtgtgggtcgacagatgtgtctgtgacaaacaagaaaaaagaaaaactgaccatttccctttgttggctacctaccttcgaaataatgcactctgtgtttgttggagggcttacatgggtcagtttgtgagttgacataaaaacttgttctgccaagtgattcaggtgagctgggaatttccttgagacccgtgtcaacgctccctgaatacaaaggcaggatgttatatgcccaagaaaagctgtcgacaaggacaagagagtatcagggtaggcgtatgtgatttttttccatttacaaaacacgtcctcatatacatcacaggtttcctttcaatctccaagaaaatcctagcatctttcaaaatccagtccagccactctactcttccctggcctcctccagtcccccaggcatctcacaggattagaagggatctcagggccccatctgtcacctgaactgttcaccacagcctcctcaaggcctccctgcctccaggcagtctctctaccgctgggcttcccttccaaagccaccctccacacagacaacatgttctttcagaagtctatttagacatgtcactcccttgatcaaactttcaatggccccctactgccctaaaggtagagttcaagatggccccagtgagctgaccccagaaatcaattgagattgggaagacctttgcttgtgagtaggtctgctaccccagttagattgtggtgacttttcctgttgtcattggtcctttaaccccacaaacttcctgaagccaaatcacagactttcctgagaacctactttgtgttggacactgtggctcacacagcattcagggttaagccagacactgcctagaattatccaggcccctgctcagagttggagaagctgttggaagaggaaaagagagcaggacataacattcactgagtgcccaccatacacattttgcccgcagcaacctgcaaactaggtcttatcttacagagtgaggaagtggattgctcaaggtcactgtatgtgacagaactgacattcaaatccaggtctccctgagtccaatagccaaggtctatcctcagcactacactgcctcccagggaacagtgagtgagggtctcaagagagaaggcagcccccagaccataggctgaggtctttagggccggttcagatgggactgtggtacttctgcctggagactgccagcccccctgagaaggtgctcagaggactctgcccccaccatcattatcctaatgacaacaacggccagcaggcagtttaaaaggtgttgttgttgttgttattgtcctcagagcctcactctgtcgcccaggctggagtgcggtggcgcgatctcagctcactgcaacctccacctcccaggttcaagcgattctcctgcctcagcctcccgagtagctgggactacaggcccacaccaccacacctagctaattcttgtatttttagtagagatggggttttgccatattgatcaggctggtctcaaacacctgagctcaagtgatatgcccgcctcggcctctcaatgtgctgggattacaggtgtgagctaccgcacccgggctgttgtttttaccccagagcttgaagcagcagaaaaagaggcccagcctgtggaaccagacagccccaggtgtgactcccaactcgtccccatgacacgtatgtgacctgggacaaatcactgcagccctctgtgccccggtttcctcctcaatagcacagaaattataatccatccctcaaagtcttgttgggaggatggagtaagttcacatgggttaaaaaaaatgctccgtcaactagaaaatgaattacacattctctctgcacgtataatttgatcctccaaacaatttagtgaaataggcagggcagaaattatttaaataaagtggttaatttcttttaaaaataattttaattttataagaaatacctgaatccattctcttagaaatcagggcactgtcgatgaagctgaagtcccttccccaccacctccaatctggtcccctcccacttcctcagcaccagctcctaggatgagcttagtatgtatcactgcagaccatttttagactttagcatacattatatgtacccacagaaaataactagcattgttttgtggtatttttaatgtaaatggattcatactgatgtatcactctgcaatttgcttttttctctccaacaacgtttttgaaagctatcaatgttgtcatatatagctctggttcactccatttaagtggctgtgttccatcagatgaatacactccattttatttgtccactcccttagcgatggacccgtaagatgtttccccttttccccttatcatcagccatgccatgtgaccatctgtgtacacacctcctgctacacatgctgatatttctctcacactgactcctgagtcatgagttttttgcgttttcagcgttaatggaccagggtggggcttattaattatgataatagttatcatataccgagcttttgcaatgttgtaggagagcgtgtgcgcattatctcattcagcccttgcagtaaaaccacgtgggagccaagattctctccagttttcggcagacaccgctgaggtccacccagagagacacaggattcacttagagccacatagctgggttggaacagtgtctggaccagaacttggccttcctgagccgaaatctgccccctcccccaagcagtggtctttcctgctgctcttgaagatttagagcaagaatctctggaaaaactaactgggccattccggacccagagccagaaatccacaaaatggcccagtgcaatggctcacacctgtaatcccaatactttgggaggccaaggcgagaggattgcttgaggctaggagttcaagaccagcctgggcaacatagtgagaccccatctctatccccccaaaatttgtttaatagccaggtgtggtggcacgcacttgtagtcctagttacttgggaggctgaggtgggaggattgcttagcctgggaggtcagggctgcagtgagctgtgattttgccactgaactccagcctgggtgccagagtgagaccctgtctcaaaaaaaatagataataataaaaacaaaacaaaaagtccacaaaattccaagtggcaggtcccttctgatgatatgaaaggtgtctgtctaggtcatctctaggtcagaaggcccatcctgagttttccttaatccagacattggtggctggggtggcagaggcaggactggaaggggcattgaaccatggagttctagtctcctggagctgaaacaacctttaaggagaaactgaggcctggggcagaggtggggaggactcactgaaggtcatgcaatgcaccagagatgcacagaaccaagaggctgcctgggccctgaggccagctgaagggcctgcaagcccaggctgggctggtggccagcacgagaagcaaagctggggactgcccccagaagtgtagaactggagggtggtcccccagagggagtgcctaggagcccagggggagaggcctgggttctgttcccagctccctggggcccccaccccttgatcaccctttcgctcctcctccttctcctcctcctcctcctccttgtcacctgtcatcacggaggatccttccttcctcttgtctcggccaacgcctcctgccccctaccttctgcctggatctacactttcgccccctctcattagcactgagcacacccaactctctcctttaagaaagccctccctcggccctgccttcctctccagctaccgccccctccctccttcccttcaaagcccaacttatcaagttgtcttcgcttcactctcccactcactgctcagcccactccaatctggtgcccgccccctcctcgttacaaccatcaccaggtcacaggtggccttcctggtgctgtcactgaggacgccctgatcctcacctcaaggggcccctcccccttggtctcttatcagcactggaccggtggggggcgggccctcctccaaactcacccccctctgatttcctccaccccactctcttctgctattcctcccacctctctgaccaccccttttcactcaccttcaccatctcttcccccacctaccccttcattggttaacaacgtttattagttaaaacaaagaacgatagagaaaaaagccaaacaaaaatgacttaaaatcttaccaaccagttattgccttattcattttttgcaaaaatagacgtggtgtgtgtgccacctgcataagcccatgctgtgtccacagagaggacaagggaggctgtgacagcgccctccccacctggcccgctgctctccagaggtaaaccctgccaacactatcttctaatgccttctagaaaaacgtttggttcatacaccaccatatatgtcttgatattatgtttagttaccccaaagggaccattctaacagcctgatttgtacttgtgccaccccttaaatctcggggctgtcctgggcctttccttttttttttttttctttagaggtggagtctcactagagacagggtctcgctatgtcgcctaggctggtctcaaactcctgggctcaagcaatcctctcccctcagcctccaaaagttctgggattacaggcataggccactgcacccggcctgggccttttcctactcttcacactgccttgagccagccatctcagccaccctgtggggtctttgtggtgataagacctgattcacttcttgccagctttgatttcttctttggattccagacccgcaaaataaaccatccatttgacatctccacttaggtggagaagctcacactctttgtggatctggcatcttccctggaaaacagaaaactgtctcactttctctggccctgcccacacccatctccccagatagctccactgctaaccccagccagcaacctgtgagtcacccctgaaagtccaacgtcgtcattagactgtacctgcatgctggatacaccacttatgtttgtggagcctcatctgtaagatggggatgccagcagttccttcctcccagtatagttgctgatgtgtggattaaaggagatagaacctggaaggtgctcgggtagcccttcctggcacaaatatctgcttactaaatgctggccatggttattagtgtccatgatccttccttatccctctctttgctgaccacctacatccaatcaatcgcccacgactgtcaattctcccagccggactagctaaacagtctcctatccagcctccctgaagcaactccggcccctccagtctgttctgctcttgacagccgaagtgatcctttaaaaggtgaatctaatcactgtcactcccttgtttaaacgcttcagggatcaccaacatgtctaaagtccagggtctctcctttggcttcaggctctgcagagattcagtcagagagttccagctgtgtgtggccagcatcttctctgattggtgggtgccccactgagctcactgctacatatttggatgtgcccaaagtcctctgcagcctggcaccagcaaccacctcaccagcatctctcctctgcccccatcacagttcatatttcagctggaataaattccccaaacaggatgacacactttctccctgacctctgggccatcatatgtgctgttccctgggcctgaacccctcttcttcccacccccacctggccaatttctacttatctagtagatcactctccaggaagaccctccctcatcctgctcccatagcagccttttgtaaagtttctttcactcgtgatttcttactgatggggctaagagggtttccctctattactggcttaattttttttttttcacctatggtctctaccactaaaatgcaagacatctaagggtgagagatttgctcattcaatgcgcttctgaaggctcagctcctggcacagagagggtgttcagacaacgtttgttgaatcacttattaattcaaccactcaacaaatatttgttgagcacctttccatgccaggtactattctatgccctaaggatacatcagtgaattgaaccaacaaagattcctatccccttgaagtgtacgtgctatggaggagagagggtggcaaaaaataagcatcataaataagtaaatcgcataatatgttagaaggtgataagagctatggaaagtaaagaatagagaaaggggagttggcagagccttggagaggggctgtgattttaggtggagtggtcgggttgcttttcattgaacaaagatagtcagatggcaagggagggaggcccacagatatggggaaaggagcatccagacttggcgaacagctactgcaaaggcaatcaggtgggagaatgcctgccaagaaaggaaaactcagcaggccagcagggctggagcagaggaacagggagagggggagcggacagggtgagaggggccacaggggcggatcatgtagagccttatagaaacactggcttttgtactgagagaaatgggggccactttttccaaaagctttattgaggtataatttacatgctctaaaattcacccattgtaagcacacaattcaatgagttttcgtaaattacagagttgtgcaaccaccacgcagttgcagaacattcctttcaccccagaaagagcctccgtgcccatctgcagtcaatctccatccctactgccagcaccaggcaaccatttctttcgctttctgtctctatagagttgcctattcgggacatttcctataagcaaaggcatacaatatatgatttttggttttttttttttttgcatctggctcatttcattgcgcgtaatgtttttgaggtatagccatgttatagcaggtatcagcagctcattcctttttattgcttaatagtactcctctgtttggatataccacatttgcttatccattcactggttgagaggctttggggttgtttctgctttttggctatgttgaatcatgctgctatgaacattttcgtatgagcttttatgtggacatatgttttcatttctcttgtgtagacacctaggaatgaaactgctggatcgtatagtacatttacatttaacttttaaagaaactaccaaactgttttccaaatgactgccatgtggagaataatctacagtggaacaaggatggaagctaagggcccaattgtttcattaatatcattaattaaataaatccactgagtttaaggagaaaggcattagaaccatcatccataacttgggcacgtggtgtccaggttggcaccaaagacccttgttgaggacctaggccagggaaaccctggctgcaaacccagccttcccagccccagaaaggagcagagagccctgtcatatccctacccctccctccatgctgcccaatccccagaaagcttccacgcagccaaagcatgaaaattcccagtttaaagaagaatcagcatcaggcatgactgttcgaagctgcagagtcctctcccccaagggagatgacaaaattttctttgcaattaaaattcctttgaaactaggaccaaggaaaatgcagaggagaaagcgttttaaactaagggaaatactcttctgtagcaattaccatgtgtgcatttcaacaaaagctgttgcctcctctctccctgctcttccctcctcccagtggctgcagggaactgtcccagcccaacttggcttctgcattcacactgggccctggggccttccttggcccctttccctggctggtccctgcttctctgcccactcctagctcttggattcctcacacattccagccttgagttcaggcctttactacaatgtccacttcctgtgagtcctttcacaacccggtggctcatctgccaagatgcagttccatccttgcactcacctatctgataccccctgccattgtcgctccccattctacatgggtctttccctcctctgagctcacagccctgcctctccggacagctcaccgagctctgagcacagcgctctgttagcatcttggcctgtgagtgtgatgtttgatgcatcagaaagagtagggacattggacacctgggtttccttcattcatttaatcaacaaatatttattgagccataacgatgtgccatgcactgtgctaaagtcctagggattagccatttctgtgtttagaaacaggagactaggtttttggggccaactcttcagctaaaaagggctaagaatgctaaataaaatataaaaggtatcttattaaagcatcacagagctgacaagtaagctctttgtaaggaattaccaggaattattaggtcaaaactgaaggaaaaacagaagcccagagaacttagagagcatagaaactacttttgtccagagggcatttgctgatccttgaaaatctgaatttgttttctgatgatctcacggcataaggggaattgaaatccaagttcatggcctgaacaaggtggaaaatcaggtgagagattctcaccaaaataaactggaactccaaaggattcacccttggggtaagggtgaaccagagatgacccagccttaaatcatggattggaagcctcatccacacaacttgggtatgccagggaacctcaaacctttaattttatttaatcacagaatggtaacacccacagccatatgcagatgctcactagaaaaaaatacctttatcctgggctttaaattattccttaaaataaaattcaagtacaatggccaacatgcagtcaaagataaccagacacaccagaaaacaatgcataatgagctaagcactggcagtacaatgtgagcaaacaaatgacatcccttgtttcatgggacttacagcccagcagggaagacagacatcaacactcttagcaaggatactaacaatctctgctagtggaggcatttctgtgtcctcagtttactttgcttctcaacagctttcctcatgctgacctctagttctgctcttggtttccatgacagtctcttggatggcctccaacctcactggcagcttcttctcagtcatcgtgcttccttctcctcccctatttcatctctgatggtggtgtgccccagggctcacttctggacctgttctctatctctctccaggtgatctcattcatttcctcagcattaaatatcatctacttgctgatgaattacagatttatatctccagcctggatttctccttggagttccagactgtttcatccactgtctgtgacacatctcaacatgcacgtctcaggaacatctcaaacataacacatccaaaaaggaactcttgctgcctccccaactcttcctccccaaatttgctccatcgtagtaagtatcacaccaccatccagtgttaaaccaaaaacctaagagtcatcttaaacttctggacggaattagaatggagatggaaatgatgtgaagtggtcaatttagagagttatttagaaggtaaagtggaccagacttaatagattgcccattgggggtgcagggatgagagatgccaagcatgacttccagccttctggcctggaacacttgacagatgagggtgtcattcacgaagatggaaaaccccagagaagagtcagttttagggaagaggaatatgttgagtttgaagttttttggaggcatctaagtggaggcatgagagagcagctctatgtttatccttgggcttcagaggagaggttaggactgaggatactaagcttgggagtcattatagtattgatggtaatggaaaccatcagcatggatgagattgcccagggaaagagtgaggagtctgcaggtgggttagagaaggacacacctgcaaaggatttacagaaggcattattagagaggtagtagggaacacagttctttagttttatattctaaatgctgctgagagccaagtaaaatagagactggagaacatccatttgatttagcaacatggcagtcaaggtgaccttagtaagccatctcggtgcatgttgggagtagaagccagatggcagtgggctgagaagagtaggaggtgagtaaaggagatagtgagtatgatcaggcagttttctgagaggttttgctattaagggaaggggttggggagtatagggaggtatgtgcttggttttgttttttaaagatggaatctacttgagcacgtttaaatgctgatgcctacaaacctcttagagagggctgaaggtaataaggcaggagaagggagaatccatagtataagctttctcagattccaggaaggtgtgcataggctcagaaaagaggagggccatttcctctgttgcaaagaggaagaatagaggatggacatggatgtgtttcctcatctgtaaaatgggataataacagtgcctaccttggagggctgtgatggggctttgataaatggatgtttacaatgggctcagcccagggtggtcccagcaggtggtacagcctccacaaacagcagctgctattcattatcttccactctcatgactgctccactcttgcctgtggggaataataatcaaacctcacttggttacagcacttgactctttccagaggattacttttatattcatcaactattcaagcttcacaacgaacctgggattcctgttccctgtttcacagaacagggcactgaggctcagagagatgaggtggcctgcctgaggtcacacatttggtagcaacaaagctggaagtccagcccaggttccactgccaagtcaacccagctcctgccttaaatatcatcagcattaaatatcatctacatgatgaattgcagatttatatctcccagcctggacttctccttggagttccagactgttccatccatggggtaaagatgaacacagacttagggtctcaccacccctgcacagagcccctggagtataaccctgtatgggaactccatttccttcaacacctgcagtgcctcctggagaaaggattcccatgaagaatccatgactagaatccatagctttaaactcaggaagaagaggattcaggcttgaacaaggtgccagtctcgcccccctttcttgttccagcccgagaccggagattaaggaagaagatgccttatctgccagctctatcgcttgtcaggagaggggataaagtaaaagccccctcaggcctggctcagtgctgcctatctgtcaccccagatggggccctgctcacagtctggggtgagtgatttggccaaactgcactgcagcctgcagccccagcaggccctacctggggatgtaggacctgtgagaaatattctctccctctctccttccccatctgttcccagcaccatcaggtcagaatgagtgctcctatctccaagttaagacccagccctgtagcaaggtgctcgggctggctatgccttccctttctactttcttcccctaggctctctgaatagcccttcctccaagactttgctcagcttcttccctctgcctggaattcctttcccctttgctctatatggcgaacccctacttatccttcaaggatcagttcaaatgtctcctgctgcagcaagcctacctgactcccttggataaaaacaagtcttttttgagcacctactacatactggttcctgggtgaggctctggggtttggagatgaatcagacctcagcccctgcctccagaggtccagggttgcagtccagtaggaagaagtcacaaggctggaagtccctgaggaggtggatggggaaatccgcagggggtaggcttggggcagggagaatgctgacctcaggcccccagcccaagaatgaaagcaacaggccagtttccctggcagagcaggtgcccttacttgtccctggcaggctggctcctcttggcatcctctgtctgctcaaccacccacaacgggccacgtggaatggagagagggtgcacggtgtggggagcccctggttcggagcatggctctgacgtcagactgcctgtgtgatcttggacaagtcacttctctgcactttgtctccatggcaacatggcaatagaaataggatctgcctcatagggttatgtgagaagtaaatggattacattcgtgaatgcttagaatggtggttatcaagcacttgacaaaagttagctatgctcagtactatttattattttattggcggaagatttgggacccacactgtcaattcaccctgtgcactagagaagtgcatcccctctctgggcctctctccatcaggaaaatgaggagtcatggatttccagctttgatattctgtgataggaatggagacagggctggtaattggagcaggatgggaatgaataagaaagacctggggcagagcgggacactgagcagcaaggagaccccaggcagcctgctgtggtggcaaaccatgaaagatcagtttgcagaagagagttagcagccagatcacagagggcagtcagtgtcaaaataacccttctgaggggtcacagggcctgatcaattatttggcaactatgtctaatcgttagagagataacaggcctgccagagaggagtgatttccccatcactaggggaatgtaagcaggggctgagatctaagagagatttgaacatccaaaagcagcagctggggaaagaaggagtatgccagagtgcttaaacacctcagccccagagtcaactgcttccttggttgtgaccttggcagtgacctcatgctccctggccccagtttgcccatctatataatgggggaaatgatggttattgtgagggtcagatgtggtagtgttgaagttctcatgattgctggggttactatgacctctcggccttggcccctgaagcccattcctgccatctctggcctctcccctctcccatcctaggagaaagcggccggccgtgctggagtctggggctaaggaggctccagcctgaagcctccctaaggagcttgccatggttaccagctgcctgcaaagagaggccataaatcccgagcccggggtggtgggagggagggaacccgtgtgtggggtgggaatgggggcagctaagtggaattgaatcttgtttaaggaggaggcccacgcctccccaggcctgtaatttactgcgaggttgacaagatgaaagcggaattttcagtggcataatcgctgggacctcggggagctgcgggagatgagctgcgaggcaggcggtggccgccaggctttaagcaagatctggggcactgatcctgctgtgatcacagcaagcgacagaccctcggagcggggccaggcccagctggataagcccaggctcaggccacgtcttgcctgctattgtttccagggctgaggtcggcccgagtttttagcaggttttatgtgatggatcataccacccaggacggttttgaccctgtagctgctgacagccctcagccaaagtcagctgcctcaccccacgtcatgcctttaggcgggtgaggggacagaaacccatgtccaatatctggtagatacatggattcaaaggcctggccccttgctcgatttggagcatcccagctccagagttccctgtgggagcagctgaggcccctgctgagagagcttcacagttcaacttctccctccacgtggtcctgcttccctcacccctgccacggtgttcctgagaactctcccccagtgaacctcccgcaggcaaagctctggctcaaggcctgtttccagggagctggacttagggccttccctcaccaggagttttgttttaaagcagcgtttataagtagcattggagtaggatactggcaacttcttttacagatggaaagactgaggtgcaggaagggaagaaaatcatgcaaggtcacacatggtgtcaggggctcccagcccaatagtccaactcctccatttcacagatggaaagactgaggttgggagagttgggagacgccattcagctgcagagctgagtcagggaatggaagcagagtatgctggggcggaagctcactgctttggagttggcccctagccatgtggttctcagcaagccacctctcttcttgacacttttctttgttcattggtaactggagagactaaagcccatctcaggaggatggtgtgacaattgcctaaaataagagcaataagagctcacactggttgtgtgtgggaatgagcccttcacacataccttgttgaatcactgtgaaaacatgtagcagttggctcggggctgggcacacagttagtgtaccatgcttgatctctgttccacaacttgtggaccacctgctccagaggctctcaggccaacatcagaatctgctagaagctatcccagactgaggacaggctctggcaccagactttcctagttcaagtcctggcttctcccacttcctggctgtaatcttggacaagtgacttcacctctcggtgctccagtttctttatctgtaatataacaattataataaaacagatgtggcacagatgaagcaagataacctatggagtgtgcttagcagagtggtcaaaaagtacagcctcttctttttgctcatcaaaggcacagtctctggcacatagaaagcaccctattagaacatgtggaaaaaggcaaaaaaaaaaaaaagcaccctatagaccttcctgttagtactattatcatccttactgaatctggggctccagaggcctggcaatgagattttgaacaagcctcaccttgctatacaccggcatgaccctgtcctctgatgagccctgagaactgcagtttgaccttccattgtatagaagtccagggcagggacttgcccaaggtcacccagtgttatgggatcaaagccaagctccaacctactccacttgccgtccagcctagagagctttctcccgtaccacaaagggacagattctttaatgtcatctgctcaggttacaataaaaattaactatcccgaatatgtgcatcatcaaagcagctccaagacagagaaggggctaagggagactggaatgaaatgtgtcacacatgctcctggggtctccaaacctgctctgtaatggctcctaggaggccccagacacacaccagcctgcaggtccttctctgccttggtgagacacaatgctaggcacaggacgggtgctccacaagaccttcaatgagcagagctgaggctgaggcttggcccctgaatgacccaggttccagtcctctctccctgcacagctgtgcatcctacggacagcca

SEQ ID NO: 137 - DNA, 1723 bp, Homo sapiens
ggagattccggcctggagctcccagggccgaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtaacccagagtcccttccagaagcctctgttttctgttcttctccctgtgactcttagtgattctgatgcaggaagtgtgcccggtggctctgctgccgtcactcctctaggaagatgtgggggtcatctccagagtgggtgggtggggcctgggtgactcagcacacatgcaaatcagagcaaaccaagaaaaccacgactgggcagtgtcttttctcagagagcaggtttctttatagtttggaaataaatggttcacggtccactggc

SEQ ID NO: 138 - protein, 341 aa, Homo sapiens
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELRAALVLVVLLIAGGLFMFTYKSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGNPESLPEASVFCSSPCDS

SEQ ID NO: 139 - DNA, 2527 bp, Homo sapiens
gggagtgccacgaggattgggaggggtggggcattggagaaagtattcagccaagcggaggtctgcggaagggagctgaaggcaggaagagcagcaagtaaagaaaaacacaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagcatttctttt

SEQ ID NO: 140 - protein, 365 aa, Homo sapiens
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELRAALVLVVLLIAGGLFMFTYKSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 141 - DNA, 2383 bp, Homo sapiens
ggagattccggcctggagctcccagggccgaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagcatttctttt

SEQ ID NO: 142 - protein, 344 aa, Homo sapiens
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 143 - DNA, 2446 bp, Homo sapiens
ggagattccggcctggagctcccagggccgaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagcatttctttt

SEQ ID NO: 144 - protein, 365 aa, Homo sapiens; identical to SEQ ID NO: 140

SEQ ID NO: 145 - DNA, 645 bp, Homo sapiens
atgggtaccattgtaggtgcttgcttccggcggaagttaccgcccgtgccgcggttcggcggcggcatccggcctcgcacttccggtggggagattccggcctggagctcccagggccgaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacaggaagatctgggtctgtgcgtcagacccgggccagccagccccctctcgatggggccctgctcacagtctgggggctgaggtcggcccgagtttttagcaggttttatgtgatggatcataccacccaggacggttttgaccctgtagctgctgacagccctcagccaaagtcagctgcctcaccccacgtcatgcctttaggcggctgtgcatcctacggacagcca

SEQ ID NO: 146 - protein, 215 aa, Homo sapiens [sequence omitted]

SEQ ID NO: 147 - DNA, 2387 bp, Homo sapiens
gagattccggcctggagctcccagggccgagattgagttgacaagaaggtgccagcaaaaaagaccaataaggagtccagaaaagcagaagaaaaaccaggagaatgtggtatcgtggcacccaagagaaggttttttctaggaggaggaagtgatccattgtgtaagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagcatttctttt

SEQ ID NO: 148 - protein, 365 aa, Homo sapiens; identical to SEQ ID NO: 140

SEQ ID NO: 149 - DNA, 2272 bp, Homo sapiens
ccggcctcgcacttccggtggggagattccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagcatttctttt

SEQ ID NO: 150 - protein, 365 aa, Homo sapiens; identical to SEQ ID NO: 140

SEQ ID NO: 151 - DNA, 22461 bp, Mus musculus
  misc_feature (1)  (22461): n = A, C, G, or T/U
atggggtatggtttaagtctgtgtttagtgcaaagctcctgcaaggtattgaacttggtaagcacttgttggcttactctgttgggatctgggaagcttgtacatttcccagtgtgttaagttacggaggtccatgtgggacatgactaattctggaatcatctttagactttactacaatgggtgtaaggggcccccaacaagatttctgaccactgtcccaatgagattaagggaccatttgtaaaatgctataatttggtttctggtaggtgacatttggagtatggagagcagctacccatagaccccaggtggcagctgctaaaggaaggtttgttgaccaggcccatgtggactcagggattttataactccagggacttctatgcagttgaaattcgggtttcaaaccaggaaagaaaattacaaagaaaaaggcctcaagtcacagcatggtgtatcatgttcccaactcccccagggacacaggttgccattctttgttctcgtggctaaggagcagggcttggctgtcagttaacccctgcagggtgggaatatgatgtttaccctctgagaaaagtaatttatgaagtgttctcctagcaacctcaaaatacatacatacaacaaaatgtaagccttaaagtcaccagaaggcttggtctcatgtttaaagacaccggaattctccccaaaccctaccagatgcagagttgaacctgtgactcttctccagccactcaatctcctgcctccctgtcttcacgatttacagagttagtaaaaaagaaaaaattagtgtaagagggacactggaggagcttttcagttcttagtaaacaatagcgccgaggatcaagatgaaatgcaggctggagggggaggaggtggttcagtaggcagagtgctcgccgtccaagcatgagccctgagtacgattcccggaacccaggttagaagctgaagattttgtgcaactgtcacatcagagctggggacacagagacagcaggatccttgccagagattggtgagctccaatcgatcgagagacgctctttcaaaacaatactgtggagacactgaggcagaaacttgatgtaggcctcccggcctccacacacaggtgtgcacatgcactcactgtgcagattgctctgttcatttggatagggccaggcagacagtatctctaacgagccctgaagtggcgccggggctactgttctgctgctgtgctgacaggaatgggcccggtgcacagtagcagcaggaggtttaacaagattgaaccaaatgtttagcctcagcgtggtcggcctggcttgtttgctttaaatgctttgaatgacatgattggagctggcatgaaagtcacaggcttgacaagatgtctggtctctaggaacattttctgaaacttggggttgagatggatacactgttaaagtcacaaatagttcccaagcatcatttagaacaaaagtgtgtagtatgttaggggcatgcatcacaccctaggggccagatataaggtaatctccagagcagaccacgtggacatgggtttaagccaatagcaagtctttattagctggccagggactacactggaatttgggaccccactgtagtcctaagactttcttggggtgggcttttaagcacaagtcatatcctgggttaaaaccctcagttagtgagaatagctagccagatgcagaactacagaagccaaaagaaaggttagtacattcagggaatctccaaggactctggtctttgatgcatcaggtctttgttctctctttggcaggtggtgctttctgcatggtgagtcccaaggtctgagtggtacttccattacagcatcagctgtgttaggtctgggggtttgttataccatgacatcaagataacatttgtcatgaaagacactttacatttactttatgtggtggtgtgagtatgcttggcccagggagtaacactattagttggaatagctgtggcattattggaggaagtgtgtcactgtgggagtgggcaatgaaaccctcctcttaaccacatggaagctgatcttctcctgtttgccttctcaacaagatgtagaactctcagttcctccagcaccatgcctgccaggatgctgccatgatccattttgatgataatggactgaatgtctgaacctataagttagccttacttaaatgttgtctcttataagagttgtcttggtgtttaaccccaattgttcaccctcttccaagtctgaatatccttcttatgaggacattggccagtcctggactagcataacctcatcttaacttgattgcattggaagaacacacacacacacacacacacacacacacacacacaccacacacttccatgtgtttttctatgcatgtggaggttcgttgtcttcctctgttactctccaccttactttttgagacaaggtctctcactgaaccaagatccatctatttttttaggctggctgtccagctagctaggagggcctgttgtctccacatccccaaggttaggatacaaatgcatgacttgatgactggctttttcatgggtcctcaggatcccaactctttttgcatgatagacactttactagctaggtgatcttccccagcccccacaatggtcctttatataaattcatgcaaatatgcaaatgttatggaaaatcaaaccacctagttctttcatttgactgtaaagtttcacaaagaaaaacacagagtgtaacttatgtgccgctgccacctccaccccatcatcctctgctctgtgatgttgattcactttctccttaatgtcagaattttctggaatatgtgcatttgtgtttggttttaaagtccatctcacccatcagagtgtggattctaaggggtgcaagacccaggccttccttgtgaccatccatttaaggtcaagagcagggcctttcatgtggtagtgtctcagataagtacattggatgagtaggtgagggaccaggctggtaaaatcgagtcttctctctcaggtccaggaggcctacctacctaatcacacctaacaaacagatgagctttaatctcagtcatggtagctgtgaacgtcctttattagaccaatgacaccttgcagtgcaatcaagttaagatgtggtcatactggaccagattggctaatgtcttaagaagaaaaggaggaagaggaggaagaggaggaagaggaggaggaggagggagagagagaggaggaggaggnnnnnnnnnnnnnnnnnnnnnnnnnnnnnnnnnnnnnnnnnnnnnnnnnnnngaggaggaagaagaggaggaggaggaggaagaggaggaggaggaagaagaggaggaggaggaagaggaggaagaggaggagaaaaaggaggagaaggttaaggatatttagacacagaagaaagcaaatacttgtggttaaactatgaggagatggaggcagagactttgagtgacaccagccagggaaagtccggggattcttgggcttaccagtgaccaaaaccccatgaagagaagcctgagcagcttccatcaggctcctgccataatgggtttcagttctaccttccaaagcatgaggacaaactgcactgtaatcatgagaaaatcaccctcaggtgaggtccgagtcttggaaagggtgaaaagtggcataagccacatgtcacccagcatgttttactctaacccaccacttctcttctgaagtgctgattattggttttgagatacgggaaagacgggacaccactacaaaccaaggaaacacattgaggctacaaagagaaactgcagaagcatactgttcccccatgcatgctgcgcagcaatgcaacctgagaatgtatgtgtgtgtcttagtcagggtttctattcctgcacaaaacatagtgaccaagaagcaagttggagaggaaaggatttattcagcttacacttccacattgctgttcatcaccaaaggaagtcaggacaggaactcacatagggtagaaacctggaggcaggagctgatgcagagaccatggagggatgctgcttactggattgcttcccctggcttgctcaacctgctttcttatagaacccaggaccaccagcccagggatggcaccacccataatgggtcctcccacccttgatcaccaattgagaaaattccttacagctggatctcatgaaggcatttcctcaagggaggcttctttctctgtgataactccagcttgtgtcaagttaacacaccaaaccagccagtacagggccagggggtggaactctaaaattagacaaagcatgtagaatttgggtttgggaggtggggggtgtgtgtggaatcacttgggagtgggtgggtggatgggggagcaccctcatagaagtgggggagagaggatatgagagggtgtttccgggagggagggagggaaaccaggaaagaggataacatttgaaatgtaagtaaagaaaatatccaattgaaaaaaaaagaattaaaaaaaaatgctgtaaacctaaaggaaatctgtaaaaatctgctgagaactgcagtataattgttgatggattcacaaagagaagaatgtccccttttccctgtgtaggactctcttctgtttattttaaatcttctcagtttcacaggacacagccacccattccagcccatccttttacactctttcaaataattatgtatcgaccatccatgctccaccagtctgacccacttctaagtcatgcatgtaactgatttcccgttgtgccttgggcatttaagacgcttcctctgctagcctgggtgcgcgaggctatagatcttgtgcgtgtaattacaaatggccatatggcggtctgtcatgcaagtgctgcatggtttgtttatccaagggtgtaaatctccgggttataacaaaaggctgaaaaccattccaagtacagaaagcatcggtggtatttcctttctgcattgtgactgagtcgcctggaatttcttcgcatcttgccaatgaataaacagtactcaggctcctcgggcatctgtcagaactaaaggtctcagatgtagcttttaggataataaatggaatataaaataataaacacaaaacaaacacatggttcttgtttaagtgggaggattacagttggcccagtctgagagctagaagtcagggtgattaaggagcagagagctgccagcgctaccatgaattatggaggacgagggagcaacagagtgggagagagccaatttgcttgtgaaaactttaaaaatgtttgccagaatccctgaggcggagtagctcaggagtaggagccctgcagcatccgtcagccttaccagaggagactgaggctgcccaggctagtttggagatgcacagtgagaagagaaaggctagacacgtgcttcaggctctgctatccagctggagctgggttcttctacctccttcaggagttgaatagtcaatcaccctctctctggaacagagggcacaggctgcttcctatggcttctacgagggtaagatgggtccatctgtctgcctgtgtacctctgccctttctttaaggaactcacttttcttgacactcttagcagtatcctgtgcctgcaaccaaggtcccattgtggagtggccctgtgcttgagggcacctccgtactgcagctcatgggtgctgtgtttcttttgctgcaactgaattcctgcaggctcccagtagcctctgtccctatagcctaccagcctttagcagatcaaaccttgcattctaaagtaagggagatacagcagaaaggcaggttacagtcatctaaaaatgtacacacatctctctcacatgcaggcagatcaataattatatatatgatatcataaaatatcatatatatatatataatttacccaatgtttattttataattaatggcacattttgagctatgtagtcatcatgtcttattttaatattgcaatcagtgggatgtactttttacagtattttcaggcttatgaaagaacagaacagtaagtggagggagttcccagaatttcctatgatcagcatcttgccctgagtgatgttgtctctgttataactaatgatctagggttttatagtattaccaaccaaagccaattgcttgcctacttcctgtccagatgtatttttggtgttttgcatcccatgagttgataaggtgccctcatcacagtctcttgtagggtagctttcctgctccaaagtcccctaggctctactcactccccattcccttattgagaaccacaaagcttctattatcaacatacgtttgccattgacaggctataatggagctgtactcttacagttcatagcccttttaggctgttttctttgaaaaaaaaattatgggcacatgtgtgtgcatgtgtgtacgcatatgtgtgtatgtatgtacatgtgtgttagcacacatgagtatgcacatgtgcatgaatgtgtgcatatgtgtgtgtgctaatgtgtgtgtgtgtgtgtgtgtgtgtgtgtgtgtgtacatgttctggtttcatttctgatgcagtgacaaagcactctctctgacaagacgaaacttagaggagaaagggtttaggcctttcttacaaatgtaagatctgtagtaatgtctcttcttacctttgtccccttgacattccctttcacccttgttcttcctctgtgccccatccccctcatcaatttttctagacccttgttaatttaatcaatcattttaaggacaagtgtcagttccacgacagctgttttagcattttccatttcattgataatcttctctgacctttatttacttctttctatagaatttgctcagctttcccaagtgttctccacacacaagcttaacttactagtttaatgcctctgggaagggaggattcttagacatgctggagaggctcgggaggacagtgaccttctattagcctaacgtgtcaatgactgtgctggttcctctgggcattcattcctttactccaaacccatacatgactactgttctcaaggctcactgtgtcttcctttatcaagagaacactgataagctgcacaaacagctccccagcacctccatccaaatggagaaaccaagtttgaccttgataacaaatgaggagttgcaccaagcctgcttgcatctggtcttcaggagcttgtgcttggtccctggggcaacatggtgcatggtgctctgcagttcctaccctgggactgcactgctcatctttgcattagtaactccttcgccagggtcttcaggtagacacagcaacactgttcactgttttctctgcttcccaggtgcactttgatgccgtagatcgatccacagggaaagttgtggatgaatccctgattttcaacattagaatcagagatgtgaatgaccatgcaccccagtttcctgagaaggaatttaacatcagtgtgaaagagagccaagccgcaggtgtgttggggtgtgtggtactgtgtgtgtacttgtctttgccctggatggcttttatttatttattttttaccttcctgctttgatattgatgaggactttgatcccggtcatccagggagacttttcacgcctcacatttttaaagttgcaggcccagaaccacagaagtcttcgctctgccagtgttggtctttccaagatgtggaagctgtggccatctggagagctggtgtgtaaatgctgcctagcaacggaggcacacctagagggacagaggtggagctgtgggaggctcacaggggctttgcaagtatcccatctgtagaatggcaggaaagtgatgtctaggatctgagcttcagaaactaagtctctacatgctaaactaacgtttctagaagaagaatctatgttttaacaagggcagtgtctaatattgtaaagcagtctttggactacttcaagaattaaaaatatggagatagacggcatttccagaagcttttaaagttgtagtattttttttttctttgtgtgttttatgcatggttacctaaaatttgtgttgtgtgtgctcatgcatgatcaggttttataaatgaatgtaaatacatgttcacacatgtactattcatgatagcagaaagtacacatgcattcattctgtatgtatatatttccttgttgttaaagaactttttggggtcagtgaaatggctccaatggtgatgtgttgctaaagcccgaggccgcaagttccatccccagcactcaataaaggagaagggagagagttatctccaggaagctggttttgttgttttgtttttgttttttttttttaaactaagaagtggagtttttattcttaatctatccattgtaagtactagtcagtatggcctcatccgttcagaaagatctgaaatcagcaactcatgtttcttagaaatagcttgcttcattctcatttttaaattttttattagatattttcttcatttacactttaaatgttatcccctttccaggttccccttccaaaccccccttccatcccctctccccctcctcacctacccacccactccagcttcctagccctggcattcccctatactgggacatagaaccttcacaggaccaagggcctctcctcccattgatgaccgactaggccatcctctgctacatatgcaactagagccatgactcccaccatgcgttttctttggttggtggtttagtcccagggagctctggagatactggttagttcatattgttgttcctcctatggggctgcaaacctcttcagatccttgggtcctttctctagctccttcattggggatcctgtggatggctgtccaatggttggctgtgagcatccacttctgtatttgtcaggcactggcagagtctctcaggagacagctgtatctggccaggaagctgttctttaaccttccctttgctctgtgccatgcatgccccatcacacagacacatagtgatgataaatatttcacttacaacacttctctatacatcttgtacactaggtttttttatggacaatctctgaggtatctcggtctcctactgcaaactgtttgttgatgccttttaaaaagtatttttgtagccgggcagtggtggcgcatgcctttaatcccagcacttgggaggcagaggcaggtgaatttctgagttcgaggccagcctggtctacagagtgagttccaggacaaccaggactacacagcgaaaccctgtctcaaacaaaacaaaacaaaacaaaacacaaaacaaaacaaagtatgttttgtagagtgcacttgaaaaacatactccaggtaagttgtgctgcagtcaggcagcattcatgaagcctgatctctggggaagaaaaggtggatgctgcaaacgagcctgaactggagagcatcacatattcacggagaacagcaataactgtgtgccatgggctgtctgtgcatccttcctattactgttaacaccttcaagcactttctcagccttttttgtaattaattgcttggtttttgttgtgtctgttttctgttaatattttctgctaatatgtttgtcatttccttcttggtcacagcttgctccttctacatgaagaacacatacttgccacaagaatttcaaatatactattcggtttattttttacttttacattttgtctgtgcattttgtctatacgtttaaaaacttctccactcttctgcgatggtaatcactactggaaagctctttgaagtttagccttggttaaatatccacctgtatcttgtattgtatgtctctatgatgaattctcatttaaatatctcatttattccggtgtgtgccctgatggcacttggcaaagacttttccctctttctactttgacaaactgccgttagccaccaataacattctcaaaaacttctttctaggtcaacctatttttcagttgttaacggtcgatttggaccaagaaaacactccaaactctcaagtcctttatttcctcgtctctcaaacgccattactgagggaaagtggctttcggattgatctcatcagcggggaagtgcgactctcgggatgcttacattatgaggttatgtagattttatcattttaaaagctccagggctggtgggctaactgctgtcagagtacttttacactagcaggcagaccctggctccagccaaggagagccatgtaaacaacagttgagagctctagcagagtccctgttgtccagagctactgaaagccacagatctagaccccccccccagaaagccacagatctagagtgctcccagacagccaggctagccaaactggtaagctccaggctccacgagagagagactcagttaaaaatgaaggcagacagtgcctgaagcaccacacccagggtggacctctggtgcgcccacacacagttgggaatcctctgtgtttgaccgttgctatggaaattgctagaaggaaatgcccttgttaatggtcccctttcctgtgtttgtgaggcttagcagtctttttctttccctgtagactgctcctctgttcacactgatcgtcagagcaagtgattgtggagagccatccctgacatccacggccaccattcatgtcagtgtggaagacagcaacaaccacatgcccacatttatggaagaccgtgtaagtcatatgctgcctgagtttcaaggcctctcacaaagggtccccaagtcctaggcttaggtgctactactgggtcatgagcaagatacatacaattatccagagtgacctaaactggaaccaaggagtctgcctggggacttaacagagtctccaggcatcgtgttctttttaatgagtccagtctgtaaagtaacccctgtccaagtgtgaggactggagaatgatagtcatatatccactgaggacaggcaggaggatgcatggggccgttggcagccatctttgcctaattggtgagccatgcatgggccttagtgggacacctgtctcaaaaagcaaggttggagcctttaggatgactcagtgggcaaaaggacttgctgccatcccgaaacccgtggaacacagatagaaggagagaactgactcctaagttgtctttgggggctcatgcaagtgtatgtgccaatcacaacaggatcaatcacaagcattgattctgagaggggcttcctttgatgacccagtaaatgccctgtaccctcctgggccctccaagcctttggctctttcatcttcctcatcatgttctatttaatgaattcatttgttctagtttctgcctaatcccctacctcccatgcatccattgtcagctcctgggagatatttattatcattattaattgttttgccagcacatagtaactgttgcattaatgattcaagcaattaattttaaaaatgtgtcatttaaatttttttaattacataaaccaacgtgggatgttttcagatgaaagcaactcatccaaatgtttacacaaatggcagaataatcttacagtgaagccttgaatcagaagcctcccctggcttaggacaaagctatgtgttcaaacgtaagcctggggaaaaatacattgctgacctgctgtgcttgctcggagacctatcgccacaaaattctgaaaatccagccatttcaaggaaccacgtgtgctggaaagatggtcaccttgatccaaacaaatctctctcttgttgaggaagagctggggtacttaaggctcgtaggctgagatgtgtactgcatctgatatctttattatgcactgactatgcttaaaatcacccagctgtagacacggagtcatgccatttgtcatgccatttgttagaaggatcccgctcctgactcaatggtattttctgctataactggaggaatgccaatacccggagcctgcgggtgtcttgctaaggacctacctctccctcctctcggttcctgccctcctcctcttgcttcctgcatccctcctctcacttcctgctctcttcctcttgcttcctgcatccctcctctcatttcctgctctcttccttttgcttcctgcatccctcctctcacttcctgctctcttcctcttgcttcctgcatccctcctctcacttcctgctctcctcctctcacttcctaccctcctcctcttgcttcctgcatccctcctctcacttcctgctctcctcctcttgcttcctgcatccctcctctcacttcctgccctcctcctctcgcttcctgcatccctcctctcacttcctgctctcctcctctcacttcctgctctcctcttctcacttcctgctctcctcctctcacttcctgccctcctcctcttgcttcctgcatccctcctctcacttcctgctctccttctccatggtgtgtctttgtgccagtgacatggaaacgatgattatttcttccagtatgagattcggatttctgaaggtcaagtcgaacagggtgtgttgtatctccctgtccaagatggagattctccatttacaccagcatggagaacacaattcaacatatgggatggcaacgaggagggccattttgatattgtgactgaccctgagaccaaccaagggttgttaagtattatcaaggtaaagtcaagaccgggttgtggtgggtgttgtagtccttgtctggaggacaagccataatgcctgaggggctggtacctgctaaacactcactgtgtgtcaagtgtgtgttgtgccctgggcaacccttagaagaatgcaggagcagatgagccctttgtctagaggccaaggactcctcttgcagaaatgataataaccaacttttaaaaatcttatttgagtgcctggtgtggtggcgcacgcctttaatcccagcacttgggaggcagaggcaggtggatctctgagttcgaggccagcctggtctacagagtgagttccaggacagccaggactactagagaaaccctgtctcgaaaaacgaaaaaaacaaaacaaaaacaaaaaacaaaacaacaaaaaaaacttatttgatgctttgatgttgctgttggaggtaaaatttactatgttcacatgagccctggaggttggatgttgttgttgttgttgttttgttttgtttttcctgatgcaatgaaagtgaacttaaaaatttattcattttcttggtaaagggtttcaagtcttggagactgcccttgaattcactatgtagtagagaattcccttaagtttctggtcttgcctctaactctgcagtgctgggactgtgggtgtgcacccccatgcttgctttgtgtggtgctggggatcaagcacagtaccttgtgagggctaggcaagggcaggactggttgggccgcattcccattccctttaaacaggcttctccaactaaaagttcttttaatctcctgggtttaaaacattttaaacatctgaagtgtaaacattggggcatgtgtgatgagcagaagaatctatctactacatgcagtggagtagctggccctggagggaaatagtcttgccatattttataggtgaggaaataaaagatcagaccgatccctttatatagagtcacatagctgagagggtggcttctgacagggcactgcaatgctgagtctttgtggctttcaaggagacacaaggatggccagtgcctttcatcgtacagcaaatcaattgcaaggaccagctggagtcaatacatctggtacagtcgagagtttgcctgttagttgaacaagtttcaggaaataccaaggagtgacagtccacactgtgcatagcaaggtccctgacagccttctgcacagtcgcctgccactgagttatttgtcagaagccatctagaaaaggctaagatgtgcaagtgagttttctggagatgagctaccatctttacaaggccttcagtgggagagctgtgagatgcaaggtcaccaaagacttcattctaaggagacacgggaaacctgcctctgcactttcctgccatcagcagtcagatctccccttccccactttcccagcatagatgcctctggcctttggagaggtcaaacagaaaggggccagcctggcactggaatattgcaattcattttttcatggtggcactcccttccccataacgacctccctggggcggaggttggggatggaggggcagcggcagatgccagctttgggaacagacaaaaaagcaacataccctagtccctgtgtcaccaaggctaacactctccttgatagataaccaacatttctccagtgcagatggctcctgcccttgaagggaacaaggaccagacattcttgaattgataagaggcccactcttagaccatgagaaaagggcaattaagtgttcctaaacagctgtgaccagtttgtaaaaatacaccagcttctgataataccataaaattactttccaggtcaagaaggtcccctcccagctgcatggttccatcctgatgtctgaacaaatgttatcaggtttaaaacatggctttcccctgtcacctctccagtcatacaaacccaaagatagaggatccctgcttgtatatatatatatatatatatatatatatatatatatatatatgtatatatatgtatatatatgtatatgtatatatatgtatgtatatatatatgtatatatatgtatatatatgtatgtatatatatatatatatatatatatatatatatatatatatacacacacacacacacacacacacacacacacacacacacacacacatatatatactccaagcccctagacacaggcatcatatccctaacctgcccagtggggaaggcttttgatttaggtctggcttgtgaaataaaggctctctttgtttttacatcggacttgtgattcctggcattcttctggggttcctgtaaactggacataacaatcccagattgctttttgctgctgatatgcctttcctgtcactattacatagcttaatgattcctgggtattagcccacactattgagcagattttctgcagatcaacatgaagatgtgctctgatgtagtagtgctatatagatgaaatgatgatgttatgatttctgatattttttagaactcttaaattgatacaagtaatttcaacacccccctcccatagaataaatttacaaatagagctttgtaaaccttcatgtgtgatggaccgattgcagtaggataataaagccggtttggaacaaatttgtgatcaatgaaaaacattcattctaggtcaggtccaaggatgaagccttccgtgttcactatgataaagcaaggccatgtgaaactgttgctttgaacttataatgagcttacagaatgaaacactgctttgaccttaatattcacatcctctgtaactcccttttgtgtaacattttatctgtgaggtgattttatggaaaccttttgtctaagaaggaataaattgccaaagataagtaataaagtgtggcatttggggctcagctccatctaccaaatgtatatctgtatatgaatctatgtctatatgtatagatatgtgtgtagatatatttgtatgtatgtaagtatgcacaaacgtttgtggaattgatgagacaagaggtctggcagggccaaagtgtgtgtatgtgtgtgtgcacgcgcatggattcttcttttctctttgactcacaaagagttaacgagctccaagcctctcctggctagcaaggggcccttgagccagagagaaactaagtctttttttttttacttcccccatgctatcagctggaatcaaattaccagaagccagaggcttttggccttagaccagcaaagagttaaaggaagacaaaaattaccagaagtaagcatctcttgaccacagaatggcaaagagttaaagacaggagaatctccaaagagaaagcagctttggcccctgctgactccaaacccctttgctgccttcctgggggaaactgggtgtctggatttagcccccagcagttcttcaaacctcctgactctcagcccttccatgtccctggccactttgtaccctgagtaactatgatcattagtatctatatttctccaagttcctctgatttttttttcctgtggtatggttaacacttaaatgtttcatgagttctggtttttgttgcatttttcatcaccgtctgatggatggaggctctgtgcagccaggagaggaggaggaaagagtgagccccataagtgatttgaaagggatctgaagactggcttttgatcatttccatcctctgttggattcctgatgactctgcggagcttcctgcagccaggggagcagtgggtactaatcaagcctcctcttaccttggcagcctttggattatgaatctcaagtagcccatagcctcgtcgttgttgtggagaatcaggagcagctcttcgtttgtacggagggccagctgcagccattgaggaaggcgatggccagcaccatggtgagcgtgcaggtgctggacaccaatgacccaccagcctttcaccctcagagcttcattgtcagtgaggaggatggagcctggcccgccatccagctgggatacttcaatgctacagacccagacagggctgacagccagataaggtgggcacagaggagcaggaatcatggctggctctgagggggcagggaggggactgttggacacctgaatgctacagaatcttgctaagactggttcagtccaaggagtaaaagtgtaaggagctacctggtgaatgcccattggctggattaatccaattcattattcagctcctggctgggttagcctaacttccattcttactcattagcccaactcagttctacccccacccacagctccctcctggaccccccttattctctttgcccattcatagccatatatatattacatattctgtaatgtggaatagtggtacagatgcatagtggttagcaaccagacatgcttccaatgggtgtcatctgatggcagccactcccagaaatcctagagtcttctgcctactgcttaaaatggttccatgtccacaaggtgaggagtacgaagatgatcctcaggtgagggaatcctttgggatctgctacaaagcagacactgcaaaaggagtcagacttgtgtgtccgtggtatgctgtactgagcaggaagccaccacctactgatacctgaagactggttctgctcccatattaagtgtttcccaaggcacacctcctaggagaaagaaacttattctagtgatcctagacttggcacactgttgaagtcttctctgtcatcccaagccttcgagctcagagtacgtagatgagcatttgggtttcaattgtctttgaattactcgcagtgggaattgtagttaccttagggtttctattgctgtggagagatgccattaccacagcaaatcttgaaaaggaaagcatttaactggggcttgcttgcagtttcagaagtttagtccattagcatggtagcaggaaacatgcagatgggcataaagctggacaagtagccgagagttcttcatccagatccacaggcagcaggaaaagcaagaacctctggcttggcttgggcttcagaaacctcaaacttactcccagtgacagacttcctccaggaaggccacacctcctaatcctttcaaacagtgctactctgtggtgaccaagcctacgtggtcattcttattcaaaccaccacagaagttttataatatattttgatttgttattaaaaatattttttgaggcaaggtcttgaactcatggtcactagactctatatcccaagtgctgggaagacaagcatataccaccatgcctatgatttgtcttgtggtaaaacttcgtagttaaaagaaaaatgtgtgtttgtgtgtgttctctttacaagatacaaactggttcatgatccagaaaattgggtgaccgtggatgagaagtcaggagtggtgaccaccaagaagcaaatagaccgggagtcccctcatgtgaatgacagtttctatacaatcatcgtccatgcagttgacaacggtgagtggggaggcaagactgggaatgaacagtgctggctctggcctcctaagggaggccatttttagcatcactgaggaaattataaaataaacattgttttcactttgactctatgctagagattatttttgataataactcccataatggcaaaccagggaccaatactgctgaaagaggggcagtgttcactcagcagagacaattaagccagtgaggagtctgcaatcatgcccacccgtctcatctgcccgtaagataatgcagtagctctttgtcaagcccaacgatgtgtgataaatatttagcagtttcccgtacctgggacggcttgtaagctccagcaaatgtgactgagtggaacacatttgtcataaaccaggacgagtgatttttaaaacatgccttagcacatttctcaatattcccacaaggctgaagttaaacgcatccaaatataaagctgcatgtgtgaacattttcaagtaacattaaggatcatacttaaagaactctgtggatgaaagcccaagcactgtggacccgcccagcccatttgcataattatctggtggaatgttagggaagcaagatgctagccgatgtacaggaagggaagccagccattcggcactcagggttccatgattctgttatggatggcttcatgattccctaatctatttttaattacaaaaggtgatttctaaatgatcataaatttgttgccatggtcctatcctgccctcccttggggtccccagtccatcagaataattcagaaatgatgtcctggagtggagagacaagagagtttattacagaggaaagtgggcacctgaatgaatgagagcggacagtggccatagggcccactgaggaggaaagcaaattacgcttggaggagagtggctagtggccagagagaccaccaatagctttcattgttggtcaggcctcttatacttttcctacagtctctaaacctggctcttcctcgagggggcatttccctttccagtgtctgtaaggtctttgctcattaccagaaaacctttagtgggtagcaatgatcaacaggcagtctgattgattgccatgtctccaccttgggccagagtcctgcgtttctgtccctgttttcaccaactgctgatcataagggaagatccatcctccatgatccacaaagctgttagtatctgaacttgactcacgtgtggttttagcatcacagcctccttttcccagctttccccagtacactttataagatggtgtagtctgtcatcataggcaatgtccccacaggctggagctgacctcatcttccctggggatcccccatgctcccctttgagaggtacccaattccttcccagcaccactgcacgtaccatgactgactgacaggacatgtgattctatttctacttcttcttttaaaacccatcaggaacagttcatgctgcccaatactccgatacttgtgtgtgtgtgtgtgtgtgtgtgtgtgtgtgtgtgtgtgtgtatgcgcgcgagcatgcccgagtgatcatgattgcactggaagagtctaccaagcagggccacaccctgacagagaggctatggactctcacaggcaccccactcttcaggagctactgatactactgttctgtaagttcatgtttaccctctctctttaatattgtaacttctattgcctgggttctgtcctctccaaggccttcccccgctgactggcacggggactctgatgcttttcctatctgatgtcaacgacaatgctccaaccctccggccccattcccgacacttggaggtctgtgagtcggctgggagccagcccctgctgatagaagctgaggatgcagatctggacccctacgctgacccctttacttttgatttggacaatgctcagggagacgtggaagagacttggatgctgaggacaaagcagggggaaggtttgtatgtgttggaggctaattcagactggaacaaactgtgatttagggtgggggacactaagtcatctagtctcaagtacacttggagagcctaaagtctggagtgcattttgtgggagaccagccctgccagaaaggactctggacatgaggtctggggtgaacttgcctcagtggggtattacatgcctgctgtcactgctggccttcttgacaccatggatgaagatggctgcacactcagatgtcggtctcttctcttctctctcctaattttcatctgggtccttgtccttgtagtgaagagcagcaatggctgtaacaatgtgaacggtgctctttgagtccaagagcatgctaccacatgagcttttgtggggaagatgtaaagaaatgtctacttatcccagttagagagactgacaggccaaagggaggacttcatcctagcccagcttgacaagatgggggttcttacaggagcatggatgagtcaaaggcagcatcctgtgggtgtaggcagcatctgtgggtgtaggcaggattcaatgggtatagactggattctgtgggtatatgcaggatcctatgggtatagactggattctgtgggtataggcaggattcaatgggtatagactggattctgtgggtatatgcaggatcctatgggtatagactggattctgtgggtataggcaggatcttgtgggtgtaggcaggatcctgtgggtgtagacaggatcctatgggcttaggtaggatcttatgggtataggttaggccctattggtagaggcaggatcctgtgggtctaagttgggtcatgtgggtattgaaaagatctaggcaggtatgggcaagatcctgtgggtgtgtagatcagatcctggaactttttaaaggtgcttgtttagatagtataatttacagtaaagtttaaaggttacaggcatttcttctatcaataaagttgtaacataggttcatgaggagtgttgcttatattcaagaataaggggtgctgaaaactcagggctgtagatcattttggcccaagttagcacactttatcttgtatcctcatttgaggtgtggttaggaaattatgcgctgtccttgttgaaggcaattttgaaagcatcaatgggtgtccagcaggaaagactatccagttcctgggacaagggtcctcttttctgtcctatctgctccttgcttttctgagtttctgtcttgtcccactctcagagccacagccctggacagtagcaaggagatacacagggggccaatgagctcactcatgtctttctgctcttgcaggccactctgctgaactcacaatgctgagaagcgtcccgcccggggattacttggtgccactcttcatagctgacagacagggcctcgcccagaagcagacagtccacgtgagaatctgctcctgccgcagtggctctgaatgtgaggagccttcggacacatggctcctgtggtgggccctgtccccagttggtgcagcacttatggttctgtcaggtgagtgcttcctgggggctcagcccctttcactggccacaggacaacaggacattctctgcacgggtgggagataaggacgaactccaggctagtgcaggtcagaggtttccagacacgctaattaaccgaaattcagtttccatgtgcaggcaattatgtaaacaatggaatccacagaggaacatggtccaaaggtgagcatatgtttgcggtaaccatggttacagcagtgcacaggtgtctaggtgcctgagcatggctgaggttaatatgggcaccgattagtccaagaaacaatagaatattcttggccagttaatatcaagcagtgaattcaacacaagtgtaggcatctgtctgagtccccaacacgctgttaagcctcacagtcagtcctgagatggttcaatggaaccagaccctgtcaggtagcagctgagtggaagtgaacggagcctggccccccttgaagcctcttgcagagctgagcttgcacaattcttttctgttttatcacagctgctctcctttgcctgctgcggtgctcctgcacatttggacccaagaggctcagaggcttcatcccaagtgacagtggccaccagacactgattgtgtataacgaggaaagcaaagtcccttcagcccag

SEQ ID NO: 152 - DNA, 1662 bp, Mus musculus
atggggtatggtttaagtctgtgtttagtgcaaagctcctgcaaggtattgaacttggtgcactttgatgccgtagatcgatccacagggaaagttgtggatgaatccctgattttcaacattagaatcagagatgtgaatgaccatgcaccccagtttcctgagaaggaatttaacatcagtgtgaaagagagccaagccgcaggtcaacctatttttcagttgttaacggtcgatttggaccaagaaaacactccaaactctcaagtcctttatttcctcgtctctcaaacgccattactgagggaaagtggctttcggattgatctcatcagcggggaaactgctcctctgttcacactgatcgtcagagcaagtgattgtggagagccatccctgacatccacggccaccattcatgtcagtgtggaagacagcaacaaccacatgcccacatttatggaagaccgttatgagattcggatttctgaaggtcaagtcgaacagggtgtgttgtatctccctgtccaagatggagattctccatttacaccagcatggagaacacaattcaacatatgggatggcaacgaggagggccattttgatattgtgactgaccctgagaccaaccaagggttgttaagtattatcaagcctttggattatgaatctcaagtagcccatagcctcgtcgttgttgtggagaatcaggagcagctcttcgtttgtacggagggccagctgcagccattgaggaaggcgatggccagcaccatggtgagcgtgcaggtgctggacaccaatgacccaccagcctttcaccctcagagcttcattgtcagtgaggaggatggagcctggcccgccatccagctgggatacttcaatgctacagacccagacagggctgacagccagataagatacaaactggttcatgatccagaaaattgggtgaccgtggatgagaagtcaggagtggtgaccaccaagaagcaaatagaccgggagtcccctcatgtgaatgacagtttctatacaatcatcgtccatgcagttgacaacggccttcccccgctgactggcacggggactctgatgcttttcctatctgatgtcaacgacaatgctccaaccctccggccccattcccgacacttggaggtctgtgagtcggctgggagccagcccctgctgatagaagctgaggatgcagatctggacccctacgctgacccctttacttttgatttggacaatgctcagggagacgtggaagagacttggatgctgaggacaaagcagggggaaggccactctgctgaactcacaatgctgagaagcgtcccgcccggggattacttggtgccactcttcatagctgacagacagggcctcgcccagaagcagacagtccacgtgagaatctgctcctgccgcagtggctctgaatgtgaggagccttcggacacatggctcctgtggtgggccctgtccccagttggtgcagcacttatggttctgtcagctgctctcctttgcctgctgcggtgctcctgcacatttggacccaagaggctcagaggcttcatcccaagtgacagtggccaccagacactgattgtgtataacgaggaaagcaaagtcccttcagcccag

SEQ ID NO: 153 - protein, 554 aa, Mus musculus
MGYGLSLCLVQSSCKVLNLVHFDAVDRSTGKVVDESLIFNIRIRDVNDHAPQFPEKEFNISVKESQAAGQPIFQLLTVDLDQENTPNSQVLYFLVSQTPLLRESGFRIDLISGETAPLFTLIVRASDCGEPSLTSTATIHVSVEDSNNHMPTFMEDRYEIRISEGQVEQGVLYLPVQDGDSPFTPAWRTQFNIWDGNEEGHFDIVTDPETNQGLLSIIKPLDYESQVAHSLVVVVENQEQLFVCTEGQLQPLRKAMASTMVSVQVLDTNDPPAFHPQSFIVSEEDGAWPAIQLGYFNATDPDRADSQIRYKLVHDPENWVTVDEKSGVVTTKKQIDRESPHVNDSFYTIIVHAVDNGLPPLTGTGTLMLFLSDVNDNAPTLRPHSRHLEVCESAGSQPLLIEAEDADLDPYADPFTFDLDNAQGDVEETWMLRTKQGEGHSAELTMLRSVPPGDYLVPLFIADRQGLAQKQTVHVRICSCRSGSECEEPSDTWLLWWALSPVGAALMVLSAALLCLLRCSCTFGPKRLRGFIPSDSGHQTLIVYNEESKVPSAQ

SEQ ID NO: 154 - DNA, 115779 bp, Homo sapiens
ctacggcgatccaagagaagatgggttatcaccaccttggagctggaggaggaagacccgggaccctttcccaaactcattggtgaggtaaggtgcctactcttaaggaatgaccccatcatgccctctaagtaagcacgcccctttggccaggaagattaagtcttgaaaggttatgtgctagtgaggccagggagtgaagtagagcagaaggagcactggcctggggttcaggaagcctgggttctagaactcactctaactctacctggttatgtgagtttgaacgagtcacttctccatgtgagtgtctgatgagaatctcatacagcaacagggtggttaattccaactgacaggtctgctttatttggcccatgcagaggctttttttttttttaaatattatttaaaaacagggagattgtcggccaggcgcggtggctcacgcctgtaatcccagcactttgggaggccgaggcgggcggatcaggagatcaggagatcgagcccatcctggccaacatggtgaaatcttgtctctactaaaaatacaaaaaattaaccaggcatggttgcaggtgcctgtagtcccagctgctcgggaggctgaggcaggagaatggcatgaacccaggaggcggagcttgcagtgagccaagatcgcaccactgcactccagcctgggcgacagcgagactctgtctcaaaaataaataaataaataaataaataaataaataaataaataaataagggagattgtcttaaaaattttgcccttctaaagacttttaaaaatggaaagttctggccacaaggaacccacattcccacattacaacaattaggcggggcttgagttactcagaataccagtttccacccctccctattgcctccctcatgctgagggtgagcactgccttgaagaagtcacatggtattggaatagcagaatctttacaccaggctcatgttgtttatttccactaccttcctagtaccaatgggcctttgaattaagtgctgattaagttctgctatagctgtggcattctatgattcttagaagaaggaaatagtgcacgcctactgttaaaaacaaacataaagagtacagaaagttttcaagtctcagtggttaaaagtgtatatgcctaagagtcagggggagtgagtgggttcatattcctactgcaccacctccttgctgggtaagttagagatttttaacgtgtcctcatctgtacaatgcggtcaatgatattgcctacatttcagagatgttttaaagattaaataggttaaggcaagcaaggcatattgtaggcccactcattctaagctctttctaaatgttagttgtgtgatcactacttctctttccttcaagggataattgatattaataaattggtatgtgtggttccagatatttctctacagattttctgatgtgaatctgcatccaagaaatgagatcacacttggtgtgttgttctgcttgcctttcttgtttagtgatgtgtcctgctagtcattccgtggcagtgtaaatacatctttaaaggctacagagtatcccatgctatgtgaaggaagtatcattatattatttttttcatgttgatgaacatttatgctatttccaaattttcactgttacagaccaaactgaagctaacagttcaacatcattgttcctgcatctcagcccatctgtttatttctttggcagatgtgccattgctgggtataatttcttaaagatgccattgattcttagccttgatacttgattatcatagtggcttattctcatcctccttttttcttctttccatttttcctccttccagctgttcaataatatgtcttataacatgtcactaatgtatctaatcagtggacctggtgtggatgaatatccagagattggtttgttttctctagaagatcatgagaacggaaggatatatgttcaccgccctgtcgatcgagaaatgacaccatctttcacggtatctaaaacttgatatattctaagctcggatttaaaagctcttgcaagactgttgtatttggtaagcattatttaagctgactatgtgccaggttccgggagattgagaaattatgccttgtgacaagctttacgagtatgcctgagacttttgtaatcttcttttagagttgtggactttggctttgtaatgatttctgcaatcgatgtgagctgctataggtctttattctaatgaccagtgtcctagcatgatcgggatatcagaaagcatttgggtatagggtcacagaatgtttataaaatgggctaatttattttttgatgagtgacttctgaaatatggagacaagccataacagacccaatgggttgcccaataactgatgcatgagcagttgcatacctgttgacaatgtcttattgtgagtgcaggtgttctttacgatttcatcactgcaacactgtggtttactatgaagttgaaattcaggttgtaaactaggaaaggaaattataaagaaaaaagccctgaaccatgtatcacattactcacctaacatcataggaagtccttaggtagtcaaactttgttctattttgacttcagtggaatggagctgctgggaactgggcttggttctcaggcgtgcttggctgtacatttgttcattaactctttcagggtggaaagatgttgattaacattcaagaaaagtaatagttgaagcttttctccagtgatctcaaagtacttatatacacaataaaagatatacccttaactcactgataggctctgaatctctaatttttaaatcggtgaaaattgttctaaaactccaatgaacatgcaaagatgactctctaggtcttccttatctgtatgaatgcatgcctcccttctgtgcagaattcacagtgtctgttaaaaagaaggacttttaacagtgcctgttaaaaagaagagtagtcataaggagaccctgagatagcacttctcaatctttcatgagcaaacagatcacctagggatcttggtaaaaatgcagattctgttttagtaggtcagggtgaagcctgaaagcctgcatgtctagcaagctccaggtgatgcccatgctgctgttcctcgggcttccacacattgagtagggaggacctagtgatggtcatggtctgtgcaaggatggaaccaaacattcagtgctcacttgttgttgttgcttgtttgctttcaatattttattttttcctttccttttattattattattatttttaactttcattttaagttcatgtacaggtttgttatataggtaaacttgtataatgagggtttagtgtacaggttatttcatcatccaggtattaagcctagtacccactagttagttttcctgatcctctccctcctcccacccttcaccctctgagagactccagtgtctgtttccttctgtgtgtccatgtgttctcatcatttagctcctatctataagtgagaacatgcagtattggttttctgttcctgtgttagtttgctaaggataatggcctccagctccatccatgttcctgcaaaggacataatcccattcttttttatggctgcatagtattccatggtgtacatgtaccatatttgctttatccattctaccattgataggcatttaggttgatttcatgtctttgctactgtgaatcctgctgcaatgaacatacccatgcatatgtctttatgatagaatgatttaaattcctttgggtatatacccagtaatgggattgctgggttgaataatatttctgtttttagctctttgaggaatcaccacactgtcttccacaatggttgaagtaatttacactcccaccaacagtatatacatgctcctttttattctgcaacctcaccagcatctgttgttttttgactttttaataatagccattctgactggtgtgagatggtatctcattgtggttttaattttcatttttctaataatcagtgatgttgagctttttttcatatgcttactggccacaagtatatcttcttttgaaaagtgtctgtttatgtcttttgtccactttttaatggggttttttttcttgtaattttaagttccttatagatgctagatattaaatctttcagatgcaaaagaaactatcaacagagtaaacagacaacctgcagaatgggagaacatttttgtgaacgatgcttttaacattttaaatgatgtattaagggttggcattcataatgtctaaaatgggactttgtgtctaaaagctgataatgctaaagccaaatatctaacagcatttcctgaaactcgaagttgagttggaaatgcttggtgcatcacagatagatcctaggcaccatttagagcaaagagtgacagtgtggggtggggggaaacacatggcatccccattaattctgttatgtcaggttttcagggccctatgcttggagctccctggctaggccaaacccatgttctgatcccccaaacattgaccacagttgtcttttaatattgatttaggtacttatttgatccgtggccctgtcatttaactacagacttccacaaggaaagatacagggtggggattctgaggcatgccccaaccttgcctgtcactctccgtctcattaccctgttttattttctcctcaacaccactcatcacctgaaatgtgaattttgtgtttaattatctgttgatagttgatctcctccattagaatgctgatctcccctcttagaatgtagttctaagaggggagagactctgccttattgttgactttggggaaagtctgccattgccccagggtcaagatcagggctcctcacataataggttctcccttaatcatgttagatgaaggagtaaatgaatgaacaagcagagtaaaatgtagcctcggccttgctgggtgttgtgagttgaattgtgtctcccaaaaatacatgttcaagtcctaattcatggtacctacccctgtgaccttatttggatatagggtctttgtaggtgtaatcaagttaaaatgaggtcatactggattagggtgggccataacccagtgaccagtatttttagaagaagagagaatctttgacacagagacagacgcagaggagaatgccaggtgaaggtggaggcagagattagagtgatgccaaggaacactgaggtttgctagcaaccacccgaagccaggagaggcccggaagagtctctccttcggagcctccagaagaaccaaccctgctgactcctccatttcagctctagcctacagagctgtgagagaataagttcctagtgtaagccatgggggtctatggtattttgttacaacagccacaggaaactaacagccaggggcttacacactatttaggagcatatgaaatggtccaatgagaaggattaccaacaaggaagggtggcataagacatgtcctataaattaggacgtgtcctaaacactacacaaattgagcatcctagcttaaccatctgctcctgtaagagagcgtttattgttggctttggcagtccatcaagatagtacattattaaaaatcaagtaagcctaatgtagtggcaaaaagacattctagtagcacttctttactcttgagcatcctgatggggtctctaaaaccagccaaaagaaaaattgtgttcagggggtggtgtgggggaggctaacatttattaactccatgcatgtacaagaaagcagtagccctggttgagaattactgtaagatttgagacagaggacagcaacagaaaaagtttcaatttttttctgtgtatggaccttatctatttatatcaaaatatgctcatttttgtagaatacaaagctaccccaaaacccatctttttatatttctcaaaataattatttgttaatttttttcaccacacagtctaacctatgcagtagcgattttgtgttgtgcatttggcgctgaaggtgttcctatgtgctcatttgcatgtaaggccgcagatcttgtgcctgtaatttcaaacagccatgtgatgtatcaagttaatgcaccatggtttgtttatccaaaggtataaatcttgaggctataaccaaaggctggaaacactttccaagtgcagaaaatgtccatgacatttcttttctccattgtaacccgaatccctagaaattcttagcatcttgccaaagaataaacagcactcatgtttctcaggcatcttatggaactaaaggtctcatacgtagctttaggataataaatgaaatataaaataataaacataaaacacacaagtggttctttttttaaatggaaggagtacagttggcacagttttacagccagaagtcagggtgattaaggagcaaagagttgccagcacagtcatacattatggaggagaatgtagagatggtgagtgagaaagccaatttatttgcacaaaaatttaaaaatgtatgctggagtccctgcagcggactagctcagtggtagaagccctgaagcctccctcagtcctgctgtgggggaggaggagcactgacctgcgctagacgtaggggctgctgtgctaggatacctggtgggaccacggtgatggaagcagaggaatgagccacaagtctgcagggaaagggggctcaggcagtcatgcgaaacagtacagagggaaagacatttaggcccctgaggaaggggatggagagagtgttgcctaaagctttcaaggcccttagaggccccctgggagggccaccgaccctgggcactgagtagccatagagtgaagtgaggaagaatcggcggaaggtgcagtcttgatccctgactggacttgaatctgggctactctacttccaagctgaaggtgaaatagtcacttagtctctccatggtgcagagctggacagcaagggtgccttcctccagggcttccgcggggatgagcagaggccatctacgggaagggctggtgctggtgagtccgccctgggcctggctgaagctggcagccaggcttctgcaataaacctttttaccccaagcaggatactgtacctggcgaccagttgacccttgagaatccagtggtctgactgcagaacaggcctctgcctggaccaccctcgtgccaggatccgtgccctttcccactcccttttctgcgactctgaactcctgcctttgcccacagccttttcagccttcaacaaacaaaagcaccctttatactagagcaatgagagattcaggagcaagcctgattcgacttgcttttaaaaatatgtatatttatttaaaatacacatgtatattttcttatagttcatatttattatattttattaatatatatatttattttgtaagtagggacatcattttttcaaattaatggactttattttttagagcagttttagattgacagaagcacagaacagaaagcacagttcccatcctcccctccccctaccccctcccttcagattcccctattatgaacattttgcagtagtgtgtgcatttgctataatgtatgtgctacatttgctataattgttgagccagtattttacatgactattaaccaaaacccatagtttacattaggcttcactcttggcatcttacgttttatgggtttcgacaaatgtgtccaccatgacagtgtcgtatagaatagtttcactgctctaaaactctctgggctctgcccattcacccctccctacccccagaacccctggcaaccactggtctttttactgtctccccacttttgccttttccagaaggttatatagttggaatcatacactatgtagccttttcagactggcttctttcacttggcaatatccattcaaagttcctccatgcctttttttcattgtataatattctattgtgtggatggacacagcttatttacctattcacctactgagaaacatcttggtagcttccagagtttgacaatcatgaataaagctataaacatgtgtgtgcaggttgtcaggtgcacatacatattcaacacatttggaaggctgatagttggattgtgtagcaagagtacatttagttttgtaagaaactgccaaactgtcccccaaagtggctgcaccattttgcattctccccagcaataaatgagagttcctattatttatacttactttttttttttttttgagatgaagtcttgctctgtcacccaggctggagtgcaatggggtgatctcggctcactgcaacctctgcctcctgggttcaagtgattcttccacctcagcctcccgagtagtgggattacaggcacccaccatcatgcctggctaatttttgcctttttgtaaaggtggggtttcactacgttggccaggctggtcttgaactcctgacctcaggtggtccccccacctcggcctcccaaagtgctgggattacaggtgtgagccaccacgcccgatcttatatttactttttacatataaaattaatagggcttcttacaaaattttgtacaatatatgaaaaatctcaccccacccacaacttttctctctggtctaattccacagaaggagaaaataattacagagaaaatataacattcactcttcacttattagatttgatatgaagtttttaataacttctttgacaatataatgacctgagaaccctcaactgcctttattccttccaaatttatatgtattttacttttaaaaatttattttcaaaacttgtgtacggtaaaatttgtatctcttgatgtatagttctaagagttttgacaaaccctccttcaacccttaacccctggaaaccactcatttcttctccctcccaatacatttaccttgtttagaacatcatagagacggagtcacacaatacatggctttttaagtctagatttttttcacctcacataatgaatcttatattcatcgatgtcattgtgtgcatcaagagtttcttcttcttctatttttttttttttttttttgagacggagtcttgttctgtcgccaggctggaatgcagtggtgcaatctttgctcactgcaacctccatctcccaggttcaagcaattctcctgcctcagtctactgagtacctgggactacaggcgcctgccaccatgcaaggctaattttttgtgttttagtagagatagggtttcaccatgttggtcagaatggccttgacctcctggccttgtgatctgcccacctgggcctaccaaagtgctgggattacaggcgtgagccgccgtgcccagccgagtttgttctgttttatcgctgagtagtatcttgcttctcactttataaaactaaagggtgcttggactcttttcaattgtggtgagataaagctgctatgcacttttttttttttttttttttttttttagatagagtttcactgttgtcgcccaggctggagagcaatggtgcgatctcagcttattgcaatcttggcctcctgggttcaagcgattctcctgccttagtctcctgagcagctgggattacaggcacccaccaccacacctggctaatttttatatttttagtagagtcggggtttcaccatgttggccaggctggtcatgaactcctgacctcacgtgatccacctgcctcagcctcccaaagtgctgggattacaggtgtgagcaaccatacccagcccacatatggcttttatgtgaaagtcagttttcatttattgtaggtagatacctaggagtggcttagttggatcacataagtgtatgtttaactcgataagcaattcccaaacgatttctcagaataactgaacaattttgcattctcattagaaacgtataagaattctgattgctctgcatctttggctgcacttagtattgtcaggttttttcagtttagctgttctaaaaggtgtgtagcgatatctcattgcagttttaatgtggatttccctagtgacaaatgatgacttatttactatctgtatctctttttttggagaggtgtctgttcaaaccctttgcccattttaaaattgtattgtttttgtctttttttttttgagatggagtttctttcttgtctcccaggctggagtgcaatggcgcaatctcagttcactgcaacctccaccttctgggtgcaagcaattctcctgcctcagcctcccgagtagctgggattacagttgcctgccaccatgcctggctaatttttgtattttttttagtagacactgggttttgccatgttggccaggctggtcttaaactcctgacctcaggtaatccacccggctaggcctcccaaagtgctgggattacaggcatgagccaccacacccggccatatattgtttgttttcttattgagttttgaatacaaatcctttgtcagcatatgaaatggaagtattttctctcaggcaattgtcttttcatttttgtcttctcattcttacctttgtcttttcattcttttaacagcatttcttacagagcaaaagttattacattttgataaaatccaattcatcaatattttctcttctggatcatgtttttggtggtgttatctaacacattgtcatcaagattttctcctttttttactaaaagttttatagttttatgttttacatgtatgtctgtgatccattttgaattaatttttgtctaaagtgtgagatatagacccaggtttatttttttttgcttatgaacatctaattgtttcagaatcatgtgttgaaaaggctagcctttgtattattctcaaaaatcaatcaaccatacttgtgtgggcctatttctaaactctctattctgtttcagtgatgtatatatttatcttttcatcaatactatactctctggattactgtatttttataataaatcttgaaattatatagtgtgagtcctctaactttgtgtttctttttcaaaatgattttgcgtattcaaatttctttgcctttctatataattttcagatcagcttgttgatatctctaaaatattctgctagtcttttgattgggatcatgctgactttataggtcaatttggaaagaactgtcatcttggcaatactgagtctttcagtctgtaaacacagtatatcttttcattcaattaggtcttctttgatttctttcatcagtgttttaacattttcactaaatagatcctatacgtattttagatttgtaaatggagctgttttaaaatttttatttctaattatgcattgctggtttatagaaatatagctgatttttatagattaactttatatcttgtgacattgctgaaattgattttcgaaagttgaatcagcctaaaattctcaggataaacctcatttggtcataatgtactatccttttaatatatttctgggtactatttgttagtattttgttgagaacttttaactctagattcatgagagatattgttctgtagttttccctgtaatttacaaaaatttgactttgtattatggtaatattagtctcatataatcagttgagaagtttttctaccttttatattttttggaagagactgttgaattggtctttcttctttcatattttgctagaatttatcattgaagtcatctgggcctggagttttttgtttttatttcttgaaagattttaaactataaatttcactttaaaaaaatatataggactatacaggttttctgtttcttcttgagaaagttttcgtagtttttctttattaagaatttggtccatttcatttaagttgctgaattcattggcataaacttggtcatactagtccttattcttcttctaatatatgtagaatctctagtgatatcctttctttcattctcgttattgataattctctccgcttccttattttccctcatcagtccccctagaggtttattcattttattgatcatttcaaagaatcgcttttggttacatgcgattacgttggttactttctctattgttttgttgttttccattttattgatatgtgctcttacctttactattgctttctgtttgtttggatttattatgatgtctttttaaaatttcttaaggtggaagcttaaacaattgatttgagaccatttgaagtgaaagatttcacacatgcatatttgacgtggactgacttttcttatccaagtacagaagtaactgcagtggccatttaaaaatatagcatgtcagtagctgtgctagttactataaatgttcactttcccaaaaatctttaactgtctgctctctgtgatgtttcagtaatattcagttaatatatttatttctcatgacaacactgataggttgtagaaacggaggctcactagcaacttgcatgtgtttgcccagtggagagactgagatttgaacctaataataactgatcatttttttccaagccagagcattggcttgttctacacatttgctgagcacctaatctgtgccagtactgttcttgctctctggggtacttggtaaatgagggcagtctgattcctgccctccggaactctcagtctagaggaggagacagacgtaacacataattaggataacagttattttattagagtgtcatcgagtaaatggttctgcaggatttttacagctctctgcttcctaggtttattttgatgttgtggagcgctcaacaggaaaaattgtggatacatccttgattttcaacattaggatcagtgatgtgaatgatcatgcaccccagtttccagagaaggaatttaacatcactgtgcaagaaaaccaatctgcaggtgtgtgcggctggggggctgccgggcttccttctgtctctgctctgttccttttcattaatattgatgaggagcttgatcctagtcatcttcagggagagtttttactgttcacatctcaaagatcgcaggccttggatctgagcgaaatgctttgaggtccgtaagcctcattttgtatcggcaataaaatgatgtgggaattacatcagtgggaagggttgatatgtaaatgccattctaaaaataaagccacatgcagtgagggagaaagagctgggtgatgagcttctgcatatctctgcacattttttgtctgtaaaatggcaacacgatcacatctatagcctccgagttacagatactgtgcattcttaaacccaaccgactcttactagaatgtggatttattttaataacaaaaatcatttttttgtgtaatcatctctccaaaaaattccaagaaatgaaaagactgaaaaagaaagcatctttaatgttacccatgagagataacaaccattagtgtttcagtttgtattctttcagcatttttgtgtgcattttctgtgtgtgtgtatacacatgctgtgtgttaaaattatatatgtgtatgcattcacacatttttatgtataattacaaatgcatatttgtatatacatacattttttcatctttatcatagtacacattgtatatgcgtatatggtaaatatttacacatatttggtgtgctttttcacaggtgcatatttataaatttcctctctaaaggtgcaattttactgtttgtaacctgatatttttctaaaataccctgttgtgtaatattttatggatgtgctttaaagtatttgaccgatctcctatggttgaacatttatgtttttttgccactttctgttattttcataaaatatatttcaatgataaaatttaagctaaatctgtgtcccaatcaagcattatttacttagcatgaattcagagatgtagacttgctggtttgcactgtgcatacaatgtaggggtcctcatttgctgacctgcccccagtccacgaagatgcttggtgtgttgttggtctttgataactatgtgcttgaacattttgctatgtttcttcaccatttccatgttctatcagttgctttttcctttcttttcttcatttttctgttagtgtgtttgtcatttttcttgattttaacctctgcagtctatattaagaatatctgcctgccatgtatgtttcagatatattttcctgctttatcattttcttttaaattttgtccacagttttttgccagaaattaaaagtgtaatctgatccaccaatgtaagtcttctgcattggcagtcatgattagaaagttcttgatcttataactaattaaatattcatccttatcttttctagtatgtccatagtttattttatatttaaacattccactcattttggtatatgccccaatgccatttagcaaataattcatcctcttactggtttgataggctacctttatctgatagtaacaatttttaaaaattctttctagggcaacctatttttcagatgttagcagtcgatttggatgaagaaaacactccaaattctcaagtcctttacttcctcatttctcaaacaccattactgaaagaaagtggtttccgggttgatcgccttagtggagaaatacgactctctggctgcttagattatgaggttatgtggattttattattttttttaaatgaaatgtgtggcccatccttgagccccaggcttagattctacatttgtagtggggaaccctctgtggctagatttgctattgaaattcctaaacagaatatttctttattaatattttcctttcctgtatttgaggggcttaactttccttttcctcccacatagaccgctcctcagtttacactgctaatcagagccagggactgtggagaaccgtcactgtcatccacgaccaccgttcacgtggatgtgcaagaaggcaacaaccacaggcctgcatttacccaggagaacgtgaggctcctgggccgccccaacgtctaagccccaaaacaagtagcccttgggtcctaggctcagtttttctcagagagggtgttaggctgttatcatattgctgtgaagaaatacctcagactgggtaatttataaagaaaagaggtttaattggctcatggttctgcaggctttacaggaagcctggggctggcaccggctcagcttctagggaggcctcaggacgcctatgatcatggcggaaggacggggggagcaggcatgtcactcggtgacaacaagagcatgcaagacacgggaggtgggtggggaagaatgaggaacgagagaggtaagaggggccacacacttttaaatgaccagatctcatgtgaactcagggccagagcttccttatcaccaaggggatggccggagctatttatgagggatctgccccacgatccaaacacttcccaccaggccccacctccaacactggggatcacatttcagcatgagatttgggcggggacagatctccaatctatatcgcgcagtcacccaagatatgtgcaattctccaaagtgacttaagctagaatcaagaagccaaatcatattgacatagaagcagttcataatggtcacatgagcttacatttttgactgctgtatgccagaaactatgctaagaacttttacatgcatttttttcatttttgattattgaaactacaacacgatttctgttttacagatgggaaaactgaggtctaggggaagacagggaattcctgtttacttggagtcaggggttcctatgctcagcccaactgacactgggccagatgattatttggagtgggggctactctgtgtgctgtgggatattcaccagcatccctggcctccgcccagtagatgtcagtagcacccctcagctgtgacaaccaaaagtgtcaccagacattgccaaatgtccctcagggagaagaatcacccttgggtgagaagtctgcacctgaggttttcacaccgtgttcaggattctagagggaaggtgagcaggtaggctttggcctcgccttccataccttaccttatccaagtacagaagtaactgcagtgatcatttaaaaacattgtatgtcagggtccacatgggatttcccaggctgcaagactcccagcctttaagaaagcattgaaaaccgctgtgtaagatggtttgggatgggtgccccacctaaggcatgtgagatggctaagagataaaataagaatcactcaagatctatttccaatattttattttttactattctatatgtatttttaaaaaagtaaatatccaccatatttcctttctcctgactctctttcttgactactgagttaaaaccctccctcttctttcctgggacacactgtagctcctttgtgctttcttctgcttagtagtgttctacttaatcagttttatttattttataaatccccctacacacacacacacacacacacacacacacacacacacacacactcagctctcagctccatcaaggacggaatttttgcctgtcttgttcatggcatctgaaatggaatgtggcacatagaagctgttgttgaataaatgatgcaaacaattatttttaaaaggtgtcgtttaattagaaaaaaaacctgtataaaccaaagtgaaatgtttgcaaaccaaagcacctcaccagaagtatataataactacaaaataatattatgcttgaaccttgtttcaaaatcttttcctggcttggtaaaaagcaatgctctcaaaaatatggctggaaaaaaaatataccctcttattttgaagtgcttgtctagaaacattgcctccaaaagtattgaataacaagctattttgaagatctacatgtgttagaaaaatgatcaccttaatctgaataaccacaagtgtcctattttaggggaagagctaggatttttagagagcataaactaggattgtgtattattatttttaaaattcttagaaaaaatagggcattgagttggatttaagagtactttaagaattatttagcgagtcacaggtaggagggggcagatattccaacggatgcaccttctgctgtaacagacggagttgcaaatcccttagggcaggtttagcagcatgaggaatatccagggtgttgtgatgaggagcaacattctttctccttctctctcttgctctctctctgcttctctccctccttcctctctgctttccttttcaattgtgtttttgtttccatgacatggacatgatgattgcttctttcagtataaggttcagattcctgaaggccgagccagccagggcgtgttgcgtctcctggttcaagatcgagattctccatttacatcagcttggagagcaaaattcaacatattgcatggcaatgaagaggggcattttgacatttcgactgaccctgagaccaacgaagggatattaaatgttatcaaggtaacaccataccggtgacataccaaccagttagtggcagacgctgaggcctcttctgtaggatcactcacaatgaaccagggagctaacgtccgtggatgctgggtgctgagcccattacgtaccacacgtcaccaggcaaggaaggcagggtctcagtgccacttctgtgtgtgggctgaggactcctcctaccaaaatgatatcaataataaaacttattttgatatgactaaatacttcaccatttaattttttgttgttgtaggcaaaatgtaatagatttacataggccttaaaatgattattctttttcagatgtgattaaaaaatgaaaacattttcttcaacactaaaagttctttcttttcatctgagttttcaatgtttaagacttttaaagtttaaaacaaatgggagtgcatctgtgtggctccaagagtatggagagcccctggcactgtgcctaatggagaagctggcctggaagaaagtattaatattaccatctcatttactgattaggaaaccaaagcccagaggggttaggtcctttacacaaagccacacagcttgaggggtggagtggaggatcccactggggcagtctgaccccagtgcctctagtcttcattgctcacaaccagccctagagtgaccagggcctctagtgcagtgcagggcaggtgagtcacctggcgacaaggcagacctgagtcagcaggtctggcacagagcccaagattcgcctgcccatttgaccagctcccaggggatgctgatggcctgcggaccgtgctatgaatagcaaggctctgtagacgctgcaccagatgcctggggttgaattttcaaaatattcccaggctttcaatccttttaagtcaactgaccactttgtaccctgaataactatgatcattaatatctatatttccctaagttcccctgatttttttgctgcatggttgtctcattaatgtttcattaggctatggtttttgttgcatttttcattaccctctgaaggatggtggctcttttcaaccagcagaggaggagggaaaaaataaaagagaaaagaactccataaatgatttgaaaatgagctgtagactgtcttttgatcattatcaaagacaacgtaaataataaatgaagtgcaaaagccacaagctctgagtttgcaatgatgactcggcgctgggcttcctctggccagaggagcagcaggtgctaatgaaatcctctctctggggttccagcctttggattatgagactcgcccagcgcaaagcctcatcattgtcgtggagaatgaggagaggctcgtcttctgtgagagaggaaagcttcagccgccaaggaaggcagcagccagcgccactgtgagtgtgcaggtgacagacgccaacgacccaccagcctttcacccccagagcttcattgtcaataaagaggagggcgccaggcctgggaccctgttgggaacttttaatgccatggatccagacagccagataaggtgagaagagagggccaagaagggcggttgtttaagtggaaatagccacataaccaagagggctcctgttagaaaaccagctcggccgggcgcggtggctcacgcctgtaatcccagcgctttgggaggccgaggcgggtggatcatgaggtcaagagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaagaaaagaaaaccagctccttggacgtgttcacgaggttgcctcagtctccgtgatgaaaatacaagaagccacagtgcatgaccactgacctgagttaaatgtcgtcttctatccataggtttttctgaccccagcagaagaactcacttgttggttttcctttgcatcttccatgtgttccttttgtattctttcctttgtgttagaataatccgttacatttttctgtctccccctctgtaccagaagttataaaccagtacctctcttgcttctgggcaagaaaagtgagggttttttttgtaaattgtggtaaaatatacataaaatttaccattttatccatttgtaagggtacgggtcagtggcattaagtgcattcacatcgttgtgcaccatcacctccctccatctccagaactcttttcatctggcaaaacagaaactctgtctccattaaccactcattcccccttctccagctcctggcctccaccatttgactttttgtctctctgagtttgatgactccaggtcatcaaagcagaatcatacaacatttgtctttaggtgactggcttatttcactttgcataatgtcctcaaagttcatgcacgtttagcatgtatcagaatgtccttccttctgatgctgaatatgcatatgtggtattgacacatttttgtttacccactcatccatcgatgggcacttgggtggcatatggcctgaatctcttgatgttcttgaagaaatggaagaaattggcatttttgggtctatgttccatgagaccatgatcatggggacagaaaggggtcatgagtcatgccccttctctctccaggctgagctcagcagttggccccagaccccattccaccagcttcactcatttctcgtgcttacttggccttggtccacacttcagtgtgagattcctctccttacagcaacacttctcaacttatctgttgggaatggctagattttttaaaaatttacaattcattatggagtgataagtttgcaaaatataatgaaatggaattactagaaaaattttcatgcactaggtggacatgacaatgctgatgactctaagggcttctcaacacttgctcttcatttttgcagttatctcattgtgagcagccaaccaacagctcacagaccccttctggtgcacagtggtgcaccttgagttagcaaggctcttaagaagtagctgtcaaactatagtgtgtatcagtctctgggggaacttgttaaaatgcagattgctgggccccacccctacaatttcttttcttttttttttttcttttttttgagatggagtctctctctttcacccacgctggagtgcagtggcataatcttgactcactgcaacctccacctcccaggttcttgtgattctcctgcctcagcctcctgagtagctgggactacaggcacatgctgccacgtctggctaatttttgtaattttagtagagacggggttttgccatgttggccaggctggtttccaacccacccatagaatttgattgagaggtctggggtcaggactgagatttgcatttctaagaagctcccaagggtgcccatgatgctggctggggatccctttaggcaccaccaacaggagcctttcctaattcattgctgtcttcctgtctcttgaggatggttggctcatacttaggtctcaggaaatgtttggactgtgctgaaatcaagaactaacagtccatcattttagcctcaatatggctttttccaggaggcaggatgagtgtcttttgtgacagggtggaggcatgatctgggttgggggcagctttggtttcctctagttctgcttcatctgcattagctgagggagctgccttttggcctgagataatccacagaggaactctgagtttcttcccctcgtttgtaaacattgcaaaatcacagtgcttctaaggaacttctggaactttccctaagaggtgaagcagtgcacaaaaagcttcaatccctttaaaaactgtgacccacgcaacatgagagagggatccttgctgaccctttgaaaaacatttgcccagaagatgaaggaaaagcataaggagaaactgcccctctccgcacctttctgggacctgcactttttgttgttgttgttgtttgcctgagtccaggaggttcctgctgcggtgccctcaacaggtagctggggtggcaacctggcaaggttgcaaaggatgcaatccaatggctgacagctctcaggaatgctggagggcttggcgtggcccaccccttacagtggtgtcaggttcacataggtgagggggatgtagaagaccactttgaggaatagggttacccaactgtgaactgccagggctctgctgcaaagggaacacaccaggggtaaagtcctaggtttctgttgcaagggcaggttggtttttcacactaagctaacatcatctacaggccactgaagatgggttcctttccaggatgaatcatctccccaaggcagacaaaactatgttcagtccaacaaggagggggacgcttggtcttctggtgaatgtcaattccacagacctaggagagtctttaggctgtcctccctgtgcttccattcctttcgtgaattaaacactctcgtagtttaattgctcttagaatttctcaaattacttgtggtagaaatagtgtttctatgacatattttgtttttttatgcaacttttttatcttttaatgtaagtttttaattttaaaaattgctgtccgttttccttctacaagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggtgagtgtttacccaaaattggaaaaataaaatgctcattcttgcttcctgcgggaaaataaccctggtgagcgtctttcagcacagcagagaaaaggataaaataaaccttgttatcactctgcatccatgctggtgattatttttggtaataattcttaaaatggtaaacaagggaccaataccatcgaaagagggcagtattcattcagaagagacaattaaaccagcaaggaggctgcaatcaaacccagcatctttttcatctgttcatgagctaactctttagctctttgtcaaagccaatgatgtgtgataaatatttagcacagcttccctgtgcttgggatggcatacgagctcagataaatgggactgtaagggacacatttgtcataaaccagaatgggtggttttataagcctgtttcagcatttttctctacactctcctaaggctgaaactttaaacacaccaaagcagagttgaagaaataaaaatgttcaaataactttaaaattgtatttaagaaagtctgtgaactaaaacccaagctccaagtgatatatcactatacgttccattctgtaattaactagtggaatgttggcggggggcaatggagatatgaaacacgtgttcctaatcagcattaagggaggagaaaaaatggggccagtgtttcagggttccgtcattctgttatggatgattttatgattggtactttttttttcctttattttttgctttttgtatttcaaaagcttttggggtacaagtggtttttggttacgtagatgaattatgcagtggtgaagtctaagattttagtgcactggtcacctgagtagagtaccttgtatccaatgtgagatttcttagcccttggctccctcctcccctgcttctgggtctccagagttcatgatatcactcatgcctttgtgtatccatagcttagctcccacttataagtgagaacatacagtatttgattttctattcctgagttattcacttagaagaatggcctccagctctattcaagtgtctgcaaaaaaacatgatttcattcttttttatggctgagtagtattccatagtatacatatgccacattttctttatccactcattggtcgatgggcatttaggttggctccatatatttgcagttatgaagtgatgattgccacttttttgaattagaaaaagtcgttttagataattgtagattcacttgcagttttaagaaataatctagtggatcctgagtatcctttgccagttttccccaggggcaacaccttgcaggactacagtgtaaccttgtaaccagtacatcaacgcggagacgcagcgcatttgcctccccttggggacccccatggtgcccttctttagtcacacccattttcctccaccccacccatccttgatgcctggcaccattgattgaccttttgtttttttaatgaagccacattctaccttgttctacaagtgatttgaggtggtaagtgctttattagcttacccaaatattctgaatgctcataaaagcaggaaaacagatcacgtgcatgccaggagagcttatgacgttgaaagggaaacagttccagtatttcaggaatattttttttctgagagacggagagtgctcattctccagagctgtgtgtgcacgagataaacaactcctgaaacttcctccccatacaaggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtgagtttttgtattggttacgggcaaagagtggaaaatgccagatatccaattcaaacagatttaggcaaaaaaggactttattagcttaaaaaaccggagaggtctgcgttctggcagagctggctctaggtgctcaaaggatatccctggatatccttcccacacatggtctgcctttctctaggttccttcttttttaggaaactctcctcatcagggggtaggaggctgctgggagtccctgagacatattcttgcatctggcaagaagggtgtttccagggaagctccaggattgacgtcactgtttggcctgggtcagctgccctgtcaatcactgtgggtgggacttgggagggcggatgtgctgattggctggttcccagcccacacctggaccttgttgggatctgggctcaccctctcctgattcatactgagaattcaggaagtgtgggcttccctaaggaaacactggggcactgttaccagaagatgaacatgctgagcaggttaaaagcaactggcatccactgtcaacactctcttctgtgcctctagccgtggcgtctgtagactgtggcacggtttcagctgaaactgtgtgctcaagtttgtagttctcagacctggagtgtgtggtaaagcacttcgccttgcccaaagagaggtctggtctttgtccttggggtctgggtgatctctattggggtatcatgtctgacaccagtgtctctttacctggggtgtcttgggctgagccggataggggcaatgtgatttacactggggacttctggtcacatagtatcagtctattaccagagaggctggagactgaggccgcccacctgggaggcccaccaggttgcctgaccaagccccaggaggacactggagcctgaggctcaggtgaacgtccctgactgcagcatcccatgtgtgctgtccctcatcgatgctgacctggcttctcgggagtggatgatgagaagctctgctactggtgcttttctggactctgccctaggtgcctctttccttgtgtgatttacatctgtatcttttccctgtaaaaaacggcaccatcactgtaacaactttcagtgtgttctgtgagtctttctagagaattgttgaacctgagggtggtcttaggaatccgtgaacttgcagttgatgtcagaagtgagggtacccttgaggacccctccctctaactctgcagttggcttactttcatacagagcttggcccgtgcagggcgttcagtaagcgtgtgttgagcagatgagcagatgagtgagtcaatgcatgccatgttctttttccctttgcaggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcaggtcagtggtctgtaggggtgtcctgggactgtggctcctctccccaggcaataggccaggggtaaggggcttgctggggtaggggacagcggtggcaggattggtggaatggctttgagaatgacttctgggtgtactcaggctcctagatgtagatcagaggttgccatgctggccaggcaagatccctggccagcaaaagcagcttctactcacaatggaatccactggtaaatatagtcaaggagtggccctttgtttgtaataaccatggagacagcaatgtacagatattcaggctcctggacttggcaaggctaataagaaagcagcttttccaagaaacaatacaatattactggccagatagtattattgattaattcaacaaacagttatgtagcatctactggtaccctggaactgtgctgaactttatagctacacagatgactaagacgcaatttggccttgccagttcatgactgagttatacatgaacagaacaagatcctcatgaaacctctgatatgggtgagcttgtctaatctgtttttcccctttgtcttataacagtggctctgctttttctgttgcgatgctattttgtgcttgaacctaagaggcatggatgctctgtatccaatgatgaaggccaccaaacactggtcatgtataatgcggagagcaaaggcacttcagcccaggtagtggaatgtcatgctttgtgtcttatggcaaggaattcactaatacacagacatatagcatgtatttttccccccattgtgccacctcttaattcttcactcttacccgtgtttcagtagcaagtgggaaaaaattcttgcaaatactatctaactcagataaatgaatttattcttttagatcaatggttctcaaccatgagcaattttgccccataggagatattcatcaatgcctggagacagttttgatggtcacagttaggagtgctactggcatctagtgcgttgaggtcagagatgctgctaaacagcctacaacgcacaagacagcctctaccacagagaattatctgccccagtttcctaagtgctgagtttgagaaactgtgcttagggaaatagtgttttttattaagtagacgttccctaaatgggattgtgttaggctcactagttaaatgagtctgagctggcttcttggccatggctttcagtagatcatggcagaacctgctcttctaccattgtccggcaaaggccaaccagaaagctcactgcccttggaggtacaaggcctaggctctgtttctgcttttgcatctcattagcttcatcatttaaccctacatcctcatctgtgaactgggatgataaagtcaaattcttagataggttgtggatcagagaggatgcctatgaaggcacctaacacaaggcagagccatataaagtaattggccaatggccactggtttttcaaactggctgcttctgaaatgggccctacattatcttagtcatccttgcagcaaccctgggctggggttagacagacaaagagatgaaagcattgtgagctctcctgtttgtcttcatctagaattaagtggttgatttagaaaatgaacacaaaagaaatgtcaaaaggaaacacacacagaggattcggtcaccccatcttacacctccaccaatgtttttttcctggaagggagagacttattgaatgaagtcagacatttagggaaaagatattccaatgaacttgatatgatgctcctgtaattagagagtttctcaaaaatatttgattgaagaagctggtgctcgcccaaggctcccagggttctttgaattttgtcttccctgcggcatgaaggagggaagggagcagccacttaggctcctctggcaggtatgtgcctgtgcaccctcctgtgagcccttcctgggtggggaaacaggagcaagatccaaactctccagattgtgaagtcccctggaaggaatctccgcatcccaaatgtgagagcagcagtaaacttgatttgttgtgtaattttaagaagaaaaccatctggacaaacagcagtctttgtgtaacagtagaatttcttgccttggacagttccagtggctcagaggctcaaccatgaagggaaacagaaatggttcccagtcccaggagctgtgcctcagtctcctccttggagggagagagtgaaagctgctgagcttggaggagactggcaggaatgtcacacaacctgagttcaggttgtagctgaggtggaagggacagtggggatgccctggttacccttctttcccagcagctttgtgattgtctcttggaaaagaggaagcagctatggaagcagtgtgggtggaaaggaaccttggcccttgtgatgctaagaccaggagggttggagggggcttaatgacatggtggcactggtcaaagaccagctatgccagtgggacaagagaacctcatgctgggcaaggggctctgttctcttcttgtaccaacaaatctttctcttgtttcccattcacagctaaaggcacatctccattcctgcttcagtatcttagggctctgagaagtggaattcaacagacctgggtgtagattccaaatctgtgattgatcagttacataatctaactgaatctgactttcatatataaagtgagcttgatagtcttctgtctcttaagttttttggactctaatcaaataacacatgtaaaattttcagcactaagagtcatgcaataaagggtggccgccaatattagcattattagcagtaattactgattatatctctgtaaccttggtaaataaggccatctctaggtgcacttatccctctgtccatcttacatgaatataccagcttaccttgcacatccactcaccaggaacattctgtgctcttgggaaaactccatgcaagatatcgtcactagctgcacacatgttgtcacattctactactaaactatagggatgccatctgatggtgatgatctacagaaatgcatagatgccttccctgcatgtggggaagctaatgagcccttggccaacagaaatccagcacccatcaacctgagtccctcagtgaacatatatgttgagtgataaatgaatgggacaatgcacagaataccatgcaatgctggtgaccccaagagccatcaccatgagccctaggaaaagacaagcttttcaattctgagagctcctgaaatgagccttttaccatcagtttacatggaaccctgaaccatgagaagctcaacctcccagcgagcaattacaaaaggcaaacagaaataacattcttttcccacataagtcatccagatttacaggagaggtgtattttttacagtctggacttcttctgtgatggcatagatacaatgtgttttggagaaaatgtcattcctttccttctgtttttatttctgctatctgtgatttcagcccttgtcatatttctttctctgtgttctacagacatggtcagatgttgaaggccagaggccggctctgctcatctgcacagctgcagcaggacccacgcagggagttaaggtaacatgccccttacttgcttctggatttcagagaagtgactttcctggtggtttccctgacaaggaacacctgggatgctcctcccagtgccacatccagggaggttcttcttcaagtcagcaaccccagcccctacttgcaaagccccatggttcccttagcctaaaacacccttgtctttcagtggccaagttctttctactttgctgcggtgtcagatgaccctgtgcttccaaatatcactgtgtccagtgccatatggtgattttttgccatatgcatatggcacttggactagtgtatttcttaagacacttttttcttaaaatgggcttgtgtccacattaagtacatttatttaagtaggaaattttatatttcaactgtaaatgaaaacagttttacttgtataaagagcaggcaagtgtgaagatagccatgaaagaagtagggcacaatgactgggtggacgatggcactgccaaaggcccggggcccctctgcaaggaaggcagagcgtggaagccaggctagcaccagagtgacacttcctcctggatgtcataagggtgtggaaacagaattagaaagggaataattttctcaccgtgcaaatcagtgttatttaaaattgtttcccaagtagctaaatcttccattctataactagtaggtgtcccctactttgaaaacaaagttgacccaggattgccataaatgagcatgtgcctggccagggcagtgaggagggctgggttcgccgtgcattctgaccactagtctgtgctcctgggggaagggctgcccttttctagttcctacaaacttgcctcctgggctggcgagagccttctctttccttcctctgagccagtctgcaaacttctagaggtctaggtgttgccctgaggggcacactatgcactttgcatgcctcatcttattgaattttcaccagaacccataggggcgtgtgtgtggtaggggcaatcttgcttccctattttacaggggagggaaccaaagcctccaccttctaggttttggtgtatctctgggttcccttcagtgtcctgcaaatattgtagtaagtacatctctggtgactgcttaaataaactgccattcacacactttctctaagtgaagccgtcacttatgatttatggggtaacctgatactttaaaatctgctggatagtgtgaaatagcgtcaatgagaccattgtcaaggtccattgcctgctttattttctttgaaatataacttcattattgaagcgtcactattaaaataacagaaacccaaggcagaaaatgcccacaatcccatccctgaatctaaacagtttcacctgtgagtgtcaccttctagatgtcatctgcgtgtctatgcagttttcaggtgtctgtgtcatggaaagaacattagcgtcttcatgttcaaacctcctcctgccatgcggttccattgtgcctgcccttttatccctgcattccctgcctctcttcattttccttttcctcccaccgcgccctccctctcatcgtgttaatttgtgtttgcctatgaatatatgagcaaggggaagtggtgagaggtcacgcatgcccactttgtttccagctggagagaaatccattctcttttgagtaaatcagcattttccctctaggatctcgaggaagtgcctccatctgcagcgagtcagtcagcccaagcacgctgtgctctggggagctgggtgagttccagaaggttgctccctgctacggccatctcactagtgactaacagttggtccccctgagagagggccgttgtagaagattcggtgatactgtcagaaaaaggcacatagtcaatgaaaatctgagaagctgggctttttccacccgactctatttccatctatagaactaggtattattattggtgatggctgctgtttttagagttgtttgataatcctgatcaaatatgacactttttagagcatccacaaatagatacattttctcatgtccttctaagggcaccagagatcatctataaagttaaaagcacagcactttggccctgactaaattccagcccagtgactgcatgcttccagcgaaagggaggcctgacttcccatctgtgttgtgtcttcttgtactctacatacaaattccaggactattgctttgtgaaatgactttttctgaaataattttagactaaatagaagttgcaaaaatagtttggagagttcttgggggtcccccaaatataccatcttatgtaaccctactccatgatcaaatcagaaaatgggctttggcacaacactgtgagtacagttctcagtcacagaccttatttggacctcaccagtttaactagccattatttaaccaaaatgtacttttctgatatagaattaaaagaggtattcagggtctaaagagccatagaatcatatccaatttttatgagggaaagcttctaaaataaattcaagatctctataatttcatatctttgcacaggcagtatctgagcaaagatgaaaacatgatgttcttctttgcacaaagatgatgccacaaatccatcactgaagggctcccgcattgatgaatgttgggttccatgtccttgcagctgatccttctggtcctgttcgggccagctgcatggacatggaacacccaccatggcacagggcctcccactctaaagaacctctgcttggtttaatattctactgtcaccatcttgaaattcttaatttttgaacaaagggcccccaactttcatcttgcactgagccctgagagttgtgccgctaggcctgggtcctaggagtggatgtgtgtcatttgtttgtattcagggcatggccatggcaaaaggaaatcttactgggtgttaatggacccaagatagagcttgcaaatctaatattctcatgttccttcttcacaaagcaactgtgaaacttgttcatgaatttctgctatgaatatctacactctttagaattactatacctttagtacaaaaatgaaaggcaatatgactgcaagaatttctagttatgtatttgcatcctttggtaatttatttgaaatcagtaaatatttcatctttctttaagggttatggcaagccctttgagccaagaagtgtgaaaaacatacactctactcctgtaagtatagatgtaggtgttaccgtgaacaaatttaccttattgttctgcctaaaagctgtgcaaatccctgaaaattggaaatttggaaggaaagaggtgataaaaaaaaatatgcccaacatccaagcaaactgaaggagaagcgaacgtgaagagaggttggaagtagttaaggcacatttatcccgtgactcgagggcataagagcttttcagtccctggcaaatttcttttgctgttgagttgctaagacctcagtcataggctgagttttctgctgtgctttgtcacagacctatagaaattttgagctaagggggtcttagacatcatctagtcaatttttttttctaaatatgttttgcaccagaattcttcttttcaaatgagatcctacaaataactccattgtaaataaaacatctaagtactaattttgtatgcattgacattaatgacatatacctattaccaaaatagccaataaaaataatgattctgatgtaaacagaaggaagttgaatgttgtggatatagtttgcaaaattatgttaacttaacacctaattcattgcctcgcattattataaactggtttttaaagtatcaagaaaattttgatatataccaacaagcagtttcaaatcttaatggtttttgaatagctcagtttacaatgttaggattctctttgattaatgaaacatgggaccaaaagcttcatttgagttgcataaaagctaattaacatggcatcccaaatttacatgttggtgtgggagactaaaaaagatgtaaaccactttctgttatattataaaaataatattcaatattgttattgaaataatttgtaaataatgaaaataaatttcaaatactctagctgaagtatctttgaggagtcgtaggccctggggatagagttaaaccagtggctaagtccacagaagcccagagaggagagatagtgctctctcagccacagtgcagccatacatagtgtggggttaggacctgaagctggcttgaggcaaaatcaccccaagtctacctcgggaaggagccaggctggaaactgacacggcgtcttcctctggtcctggatgagccccatgcttggtcagtgagcatctggtgcaagggtactttgtacatagcccacatcttaagggtcctcctctgagaggcccctggggctaaacagactgagggcacagcatctccagtcaagtgctcccagcactgggaaccaggcagcagggtccctagggctgcttgtagtggtccacaccttgcctctttggcttagtatgtttggttcagcttaccttggtatgatgtggcttcactatgtgtacacacatgtgtatatgtacagtcatgtctggcttaatgatggggatacgttctgagaaatgtgttgttaggtgatttcatcactgtgtaaacttcataaagtgttttacacaaacctaaatggtgtagcctactacacacctagacctcttggtgtagcctgttgcttctaggctacaaacccgtacagcatgtgactgtactgaatactgtaggcaattggaacacaatggtgtttgtgtatctacctacacaggccagggcgccgtggctcacgtctgtaatcccagcactttgggaggccgaggcaggcgtatcacgagatcaggagatagagaccatcctggctaacatggtgaaaccctgtctttactaaaaatacaaaaaattaactggacgtggtggcgggcgcctgtagccccagctacttgggaggctgaggcaggagaatggcatgaacctgggaggcggcgcttgcagtgagccaagatcgcgccactgcactccagcctgggtgacagagcgagactccatctcaaaaaaaaaaaaaaaaaaaagaaaagaaaaaaacacctacacatagaaaaggtacagtaaaaatacagcattacagtcttatgggaccagctttatatatacggcctgtcattgaaatgttatgccgtgcataactgtatgtatgcatgtgtatatagatagatatgtgtattcagttgacccttgaacaataggagtttgaactgtgtgggtgcacttatatgtgggttttcttctgcctctgccacccccgagacagcaagaccaacccttcttctccctcctcctcttcattctactcagagagaagacaatgaagatgaagacctttatgataatccacttctacttaatgaatagtgaatatattttccttaatgacattttctttcttctagcttactttgttataatatagtatataatacatatgacatacaaaatgtgcattaattgactgtttatattattggaaaagcttccagtcaacagtagactgttagttgagttttcggggaatcaaaagttataggcatgttttcaactgtgcagggtcagcacccctaacccccacattgttcaagggtcaactgtatatgtatatgtctatatgtctatatgtatatgtatagaagcatgtacatgtacagaggcatgagtatgcatatatgaacatgtgtatgtttgtctgtatatgtgcatgtgtatatatctgtatgtatgtatgtatgtatgtatgtatgtatgtatgtgtatatatagcctcatggacatacataattgccccaggctttatcatattttacatatgtcttctggaacccaataagtatccctaaacccaggtaagatcagaagtcatctcagccataaaggccaccagtgattaaaaacacaaattgtatgtcactctccaatttaagacttcctgttggcttgccattgcacctgggataaagtctacaaccttatgaccttaaggggatcctccctccagggctgctttgcagaacccagcctaagacagacctatgtctttaatgtcctgtgagaccctctatcacatggcctttgctcacgtatggcttcaacttgctctgagcctccccccacctccctaaccatcccagcaccccacctctttgggctccagccacagaacacgccaagttccctccctgcttagggcctgtgctgtttcttctcattggaattcccttctgttccatggccctacaacttcctcctcctgagaactccctgctctcaactgggtgagatcccctcttaaaccttcccttggtgatcagtcttacatttaccgccactcttgggtgcttgccttgcacctgcgtgagctcgacagtgaggccccaggtgctttgcttgcctccaggccagcctgactcacatgatttagtggtgggatttgtgagcccccagatagccactccttccagtagatgccaagcctgtttcctaccactgtatcctctgcccttagatagcacagagacccagatccacagacatgggccagatgagcaggagactgccagcagcccatcatgggaaacaatgggcaggttcagaggaagagaagccaaaatgagcgaggaggggcagtgtagttgagggggtgcaaggcatgagtgagggtgtcagcaggaacaaccctcctggccgggctcacttgggttccttcctcactgaaagtttgtttcagcccaggcattggaaagtctagccatgagagcttgcagggcctccctctctcccccaacacaaagagaggaaacgtgagcaaactaccctgggcctggctcttcacctccaagagaacggtgctcagtgtgccccatctatgctggggccactgacacacaggggttggggggtaggacaagggctctgctgtggtatgaagctctactggtttgcttgcaggcttacccagatgccacaatgcacagacaactcctggctccggtggaaggaaggatggcagagacattgaatcaggtagggagagctccccttgtgctgtgcactagctatgggttttgcatccccactgtgctccaggcttgatttggggacacttcctcctaaatcactgcattagtcagctaaggctgccataataaaataccatagcctgactggtggcttaaataacagaaatatattgcctcatgtttctgcaggctagaagtccaaggtcagggttccagcatggttgggttctggtgagagctctcttgctagctggcagatggccactttcccgccgtgtcctcacatgggatggagagagagataccaagctccctggtatctcttcttattagggaactaattccatcatgaggactctaccctcatgagctcatctaaacctaattgtctcccaaaggctccgtcttcaaatgccatcacattggggttagggcctgaacatatggatttggagagggaacacaattaagtccatagcaatcactttcatggaaatcctccatccagtgctgctttgcagaacccaactgaagacagaattgacacagcacaggcaagccccaaaactggggattagcccaggagggttttgggaaataattcaaaggtgaggtggaggtgttagacagcagtcttctattcaacattactgctccttgcaaggcagggctaactcataggcagtacactcagagtcagaaatgtatgggctgttggcaactgtatttatacccactaaaacccactttcaattacatgcaaattaagcagcaggttgatgcaaacggaggggctggttatttagaactttctaggacagcagtgataacttctgggtcactgccatggcatttgtaagctgtcctggcactggtgtgagtctcttgcaccagtgagcaatgagggcatccagggttcactttcgtctcatctgctggtttctgctggttttttttttttaacttcatcccatctggaccagatcctgttttggtcagcagggttgtgaccagaaaacaagacctgctggcctcctacctcagaatgaagggtcttttcctgcaaaattgtgaaagatgtagtttgactgcgctgaaggggtctattatgtgagattctgattttgggtacatcctgaaaggtccatcaacacagccactgcgtactcctgggaagattagaaagcagcttgggagctgggcaaacccatgggcaggtttacatggatagggcagagccagtccacatgctcgtgtcatggaggctctgcatgccccctgcttggggaaggaggtaccaagaagctgcccaggccattctgactctaagcagctcctcctgttgcagggcagtgggaactcaggcctatggaatgataagcacaaaggaagacataaatgtagacagtctctgtcaggccagacttatttttttggcaaacacgtgtataatactcactttgttgtagactctgttctgaggacttgaaagatgttaactcttagtctgcacatcagcctattgggggaggtgctgtcatatgcctttttataacatgtggaaacccaggaacaaagaagttgggtaatgtgtccaaggtcacagccacagaaagcagtagatttggggctcaaatacaggcaactgggctccagggtctaggcacttagggggctcattaaaaagcagcaatccccagtaccaactctgtggaccctgctgtagtgggtctggggtgcgcatctgagcctctgacttgaggtcctgggatcctgttttgtgaaacccattggtgagcctggacgtctcctgctgtggttgtcagagtggatgacagacagggctgtgaacactgtggcctgaggaagtgagcccagactgtgtctggatgtagagtcactgtctggggtttccccaatgttgcttcctctggttcctgtcacagtccccaggtgggagctccagctctgtgccccagtgacagccccaaaggtgctgtaggcttggccccttctcactcccactccttagccctgcagaatgggtgctgcctggcacctgcttcaagacaacacagacatcttctccgggcctagaagctttgcctaaaagcaggcaagccaggctcctgcagaagggggctgtgtacccacagactcagggctgcagggcccttccccaggtcctgactgctggtgaggaagatgaaggatgagctgcggggaaatttccatgtgtctctcccgagccgactgtaacctccctgagggccaggctgtgtcattactggtgcatgacacaggggtcactgaagaagcaatgaaagaaccattttcactataacccaatgtggtagatgaatccaaaaatggaggctcagacaagttgctccaatggtaaaggcacgagggacagagccagaaatggggcacagagtggccgactacagacgggcccacctgatcattaagcagggtcagggaagtctcctctctgagccttaatttctcatctacaaaggagagttggggcagctctgctacactctcgggtgaagctctgtgcagaccagatcatgtctctacagaaaacgtagcatgtggtgatcatcacgtagtatccagcttacccattttcacatttgcgcacacacacgtgaacgcatgcacatgcacacataccgctcatgccaagtggactgtgtggacagtatcgcaggtcctgcctggctgagcaggagagggacgtgttccagccgcgggcccccctcctccctctgcggggcagggaggcagctttattcaatggaagctcgaagctctgcttggtggtgtgagaggagggaacaccagattagagggccctgttctttccttgtgagccctctaacttggatggtggtgtatgatgaattattgatctgatgaggcctccaaagttgctgaatcagggtgcagacatccactgctctgctgtcagcctgggggttttgaagttgaatccacccagcacagcccccactgcagattctgttttgctctgcacacaccaggtctgtcgctaattatctattcagcttcactgcaaggacgtgaaccgactcctaacacgtaggccagagcttgtgtatctgctggttttgccgtaaaaactttctttcctccccctgcccccagctcccccatgccatatggtcagacagtgaccacagtccctgagtaagcagacccagtcaatgggccagatgtgcaggtgagcattcccgcgcttctcgtgggcaccaagcctgacatagcagtagactggggcggggagacagcatttcccactaaacaagggcccaggcagggctcctgagaaccagaggaagctggagacagcttgttgcagtcactgggtggggcggggcggggggcatagttaagagcttggaagcccaggggtcccatcagaatggggacacgcatggggtccctggggccccagagctgccctttccaggccctccccacctcccaccttgggcttgagccccaggattctgactgttttcatgccctacatgagctcaccctctcagaattactatcagcagtgacggattagacaggctcccactaaacccattcctgccaaggtctgtagaactggcgctgggttcagatagcaccctctagaggtattagaaggtaaataggctaaagtccctctcccctcccctcccctccactcccctatttattgaatcactcaggccagaaaagtcttcacagagagatgacttgggtcctgaatgctgagctggagtttgctgggttggagattggcagaggagggctgtctaggattctaggcagacaggaatgagcagatatgaagcctaggaaatgtttctggggtttgtgcagagggtggacctaaggcaggagaggttggggagaggaggagatggtgagaagagggctgtttggagggagaaagccatggcaaccccagagcagggtggcttaatgcgcagagcaggcacctctggctcacgtcacacatcagggtgggtgtcgagccggagcctgcccagggtcctcccactctgtggctctgccaccactcagaactggaaatggggctggaggacagagaaagaacagaggctcttggggaggctttcatggccaggtacgtgtccctgacatccctatttcatcagtcacgtagccacatctagcagagaggcaggaaatgtgatcttgccgggtgaccagaagaacaagaaatgagtttagtgaacttgccactctcgccccaatgagtggagatagggacctatcctcaggcattggccatggggctggaggagaggggacagaactagaaataccgccgagcatttgagaggatggggcaggggagagttggtgatgactctaggtttcaaggttgagcagctgggctgtaggggatgtcctgacttaagtcaggctagagtttcatgaactttggtcattctgtcactactgtcacgcttgtgtttaacccactcactatgatgtatttaatgcatttctgtaaatcagctcacatgttaattagcttttggctttacaatcagctagtgtgaaatcatggatttggcgtgcttgttattgtgttttgaaatatacgataaaatggccattcactcaaataaatatgtgttctgataccatcgaaatcatctaatgatgcaggggtcagtgaacttcctataaagggccagatagtaaatcctgtaggatttgaaggccagttcccacagctcagccctgccattgttccgtgaaagcagccacagatgatacacaaataaacggtcttggccgtgctccagtagaacttaatttacaacaacaggtggtgtgctggattatcccctggcttgtagccggctagcccctgtaacagggggtgcgcactgcacttggcgagcattgagggagggacgtgggaggaggagatgtaggttgtgggcaaaaccacagtggtttccaggatgttgagtctgaggtctctgtggatgtccttgtggagctgtctggttggaattctggctctggatgtgactgtagggagtgtcacagagagagatggtgacggggacatcaccattggttagggatggatgaagccatggcctgagcatgaatggggagactggagggcagtggtttgaggagccacatgggtgagaaaggggtggcaggaagtggtggccgccctttcttgcagggaggctgtgaagtatgagcagattgaaggatagacctgagcacatttgtgggtcgggagaaaggagcccacagcaagaggccaggtaaagatgaagagagaggggacagttgtccaaacgagggccggggggtcatggaaggggaggtgtccagggcacaggacagggaagggcgagcctcaaggaatgaatctgcaagagggtgggagcaggtgggaggtcctcctgggggctcctgtcatactcctggggcggccaccactgtgtcacagttccctctcagactgtaaggtgggatgtctcccctcagcatggctgccacttctggaactgtacgaactcctgtgtcagctgaggacacggggcctgagtgctgttactactgcattgatgtgttcctcgaatcaaacctagagaaatgagctgggtatggaagcacatggcatttaccttctctttcccccacttttccccagaaactccatgttgccaatgtgctggaagatgaccccggctacctacctcacgtctacagcgaggaaggggagtgtggaggggccccatccctcagctctctggccagcttggaacaggagttgcaacctgatttgctggactctttgggttcaaaagcgactccgtttgaggaaatatattcagagtcaggtgttccttcctaaaaaaaaaagtctattttggagaattgaaataattcatggaagggaatcactattcagggatttttcccctttgctcttcttttccctccttaaaagaaaaattaccttctagtcctaggatgaggacacactattagtttgaattaaatgctttgatattctcagatcagccatcttgaaccaaagcaaaaccacaagttacactttcttaaaatttgatttgtcatattttctagagaaacttgaatttaattgtgttattcttagcttccactggcagcctagctttgagggtaaatgaaaatataacccatagattacccagccacttgggaacagcaggtaatactgaagaaaaataaaaatagattttgaaaacgttacttacatttctatgattatgattctgcttccatttaagggaaaacttaggtaaatagagaaattttttctataacatttgtagtcagtatttgaagtgattttttaaaaaataagtattggtccctgttcactttttgattagataaatagataaaatatgttatcttgagaaaaatgattatgctgaaagctttataaacagtatactctttaaaaaatgaagagctgacataatttaacttgtatgtattatgtaagtaaaagagttaggagcctttgaatgagtaagttctgattagattttatctttaaacaaaaccacaaaatttaattggtttttacttgtccacttactgctagtgtcagtttcaggggaagaaatggtttcttttaaaaatcttaataggggacatatgccctaaaaatagtcagttttctagtctgagtaatagataagagactgactaagcaaagtttaaaatgctatttggacactttaatgcacatattggatatctaaaagtctacagccatataaaaattttatataattaatgagcaaatgccgtctctcatgccctaaaataaatcagtagaaacatgtttgctggtgaatcagtgaagcattatgttaaacagtgagttacagctcagagttaaaactttctccttctttttgaagaagctgtgcaaatacttctttttaaggagatctggccttttcctacctggttacctcagtcttcctctgctttgggaagctgaaaaagaagaaaaatcacatttaaagcactggaatgtctgaatgggacgcttgaatgtgtagaacagctgtactgatcctagcatgactcagaggacagtctagggcattttctgggtaattcaggataaaagtatttttttttttaagaaaaatacatgtttttggacaacaaaacaaagtaaacattagtttattcgattgcctccttatacttgcctctttcattctgtcccctgtagatttttaaaaaattatctcattttaaaactttattatttcattttaaataattgacatataataattgtacatatttagggggtacatagtcatgtttcaatacatttacagtgatcagatcagggtggttaacgtaatcattggctcaaacatttttcatttctttgtattggtacggagcattcaatatccatcccccttctagctatctaaaactatgtattattgttaactataggcaacatatagtggtatagagtgctagaacgtattcctcctaggaataatttgctgtaattttgtatcctttaataaatctctccctatccctctttccccccacccttcccagctgctgtgtcctctgttctaccttctacttccgagataaacttggttttagcttccacatatgtgtgaggacatgtgattttcaactttctgcagctggcttatttctcttaacataatgtcctccagcttcatccatgttgccataaatgacagaatttttttattttagtggctgaataatatttcattgtgtatatataccatgctttcttcatgcattcatctgcctttggacagctaggttgattccacatcttggctattgtgaatagtggtgtaataaacatgaggtgcagatgtctcttcaaaatacagatttcctttcctctggacaaatgcccagtagtaggatttttgaattatattgtagttctatttgtagagtttttgaggaacctccatactcttctccaaagtgcctgtactaatttacattcctaccaacagcgtatgggttccctttactcagcaacctcaccagcatttgctttcttttctttatttaatttaattaaaaattttgtttgagacaaagtctcactttattgcccaggctggagtgcagtagtgcaatctcagctcactgcaacctctccacttcctgggttgaagcaattctcctgtctcagcctcccaagtagctgggacttcaggcacgagccaccacgcccagttaattttttgtatttttagtagagatggggttttgccatgttggccaggctggtctctatctactgacctcaggtgatccgcccacctcagcctaccaaagtgctgggattaaaggtgtgagccactgcatctggcccagcattggctatttttgactctttgatagtagctatcctaactgggatgagataatacctcattgtgggtttgatgtgccttttcctgaccattcatgatgttaagcagtttttcatatattttttggccattttatgtcttttgagaaacatctgttcagatcatttacccattttaaaattggattctttttattttgctgttgagatatttgagctcctcgtgtattccagataataaccccttattggataaatagtttgcagatatttcctcccattttgtacgttaacttttcactctgtagtttcctttgctgtgcagaaacttttttcgtttgatataatcctatttgattatttttgcttttgttgtctatgctttcgaggtcttactcataagtttttttacaagaccaatttcctgaagcattttccctagattttcttccaatagtcttatagttttgggtctcacatttaggtctttgatccactttgagttgatttctgtatagggtgagagaggggagtctagtttcattcttctgcatatagatacctactttccccagcaccatttgttggaaagactatcttttcctcaatgaatgttcgtagtctttttgtcaaaaatcagttggctaaagatatgtgtattaattgcttgagtctgtattctgtttcatttattgatgtgtctgtttttatagtaccatgctgtttcagttattatagttttgtagtatattttgaagtctgatagtgtgatccttgtaactttgtcttttgtgctcagaattgttttggctcttcaggaccttctgtggttccacacaaattttaagatttttttttctatttctgtgaagaatgtcattggtgttttgatagggattgcattgaatctgtagattgctttgcatagtgtgataattttacaacattaattcttctgatccatgggcatgaaatgtctttacatttgtttatatcctctgatttttcatcagtattttgtaatctttttttgtagagggttttcacttccatggttaaacttattctttgatattttagttttttgtagttattgtaaaagggattgctgtcttgatttttcagctagtttgttgttcatgtatagaaatgctactgatttatgtatgttgatttttgtctccagcaactttgctgaatttatttatcagttctaagagtttttggtagcatctttaggtttttctatatatgagattatgtcatctgcaaacagggacaatttgacttcctcctttctaatttgaattccctttttttcttcctcttgtcttattgctctggctaggacattcagtattatgttgaatacaagaagagagagtgggcacccttgtcttgttccagtccttaggggaatagtttccaacttttcctcatttagtatgatgttagctgtgggtgtgtcatatatagccttaatttgttgaggcactttccttttatacctaattttttggtataaaagatttctcatgaaaggatactgaattttatcagaggctttttctgcatccgttgagataatcatatggtttttgtccttcattttgttgatgtgatgtatcatgtgtactgatttgggtatatgaaagccttgcattcctgggataaattccacttgaccatgatcttttatctttttaatatatttttggatttggtttgctaatatttttgttgagggttttaacatctatgttcattggtgatattggcctgtagttttctttttctgtgtgtctttgtatggctttggaatgagagttatgctggcctcatagagtaagaaaggaagagctatctctacttgttttgtggaattgtctgagaaaagttggtattaatacttctttaaagtttggcagaattcagtagtgaaaccatccggccctgaactttcttttcttgagataatttttattattgattcaatcttattacttgttattggtcaattgaggttttctatttctttttggatcaatcttagtaggttgtatgtgttcaggaatttatccattgcctctaggttttcaaatttaccggcatatagttgttcacagtaattaataattctttgtatttctgtggtctctattgtgacatctcaattttttgtttcaattttatttacttgaatcttttctcttgttttcttagtctagctaatggtttgttgatttcatttattttttcaaaaaatcaactttttgtttcattaaccttttgtattgtttttctggtctcgattttgtttatttgtgctctgatctttattatttctttccttctactaattttgggtttcatttcttcttgaatttctagttccttaagatacattattaaattgctcatttgaaatatttctagttgtttaatgtagtcatttgttactttaaacttgcctcttactactgtttttgctatgttccatagattttggtgtgctgtgtttcctacttttatttgcctcaaggaattttaaaatctcattcttaattgattttctcactccttggtcatcaggagcatgtagcttaatttccatgtatttgtatagttttgagtgttcatcttgttcttgatttttagttttattctcttgtggtcagataagatactttatataattttgatttttaaaaactttttgaagcttgttttgtatcctaacatatggcctctcctggagaaagttacatgtgctgatgaaaaaaatgtgtattccgtagctgttgagtgaaatgttctgtaaagtctactaggtctatttggtaggttcagtttaaatctgatgtttccttgttgattttatatctaaataatctgtccagtgctgagagtgagatgttgaagtccccaactattattgtattggggcttatttctgcctttagatctaataatatttgctttatagatctagtggttcagtgttgggtgcatgtttatttataattggtatattctcttgctgacctgttccccttattattatttaatgtttttcttgtctctttttacagcatttgactttaaagtctgctttgtctgatataagtatagctactccagctcacttttagtttctgtctgtgtggaatatcttttccaccccttcatgttcagtctatgtgtgtctttacaggtgatgtgagtttcttgaaggcagcatatagttgggttattttaaaattcatccagccagtctttatcttttaaatgaggaatataatctgattcaaggttattatggataagtgagggcttactcctgtcattttattgatttattgattgccatgttgttattttgtatatcctctgtttcttacttcctctcttactgcctttttttttttttttttttttttgcagttgggtggtttcctgtagtgatgagcttttattactttttttcccctttgtttttggcttttccagtgagttttgtagttttgcatgttttcatgattgtggttattttcttttcacttctagatgtaaaactcccctgagcatttcttgtaagatcagaatagttgtgatgaattctcttaacttttgcttgtctgtgaaagattttactttttcatttctgaaggatagctttgcttggtataatattatagtctggcaagttttgttttgtttacagtacttcgaatatatcatccaattctctcctggcttgtaaggtttctgctgagaaatccgcagtctaatggggattccattatatgtgacttgatgcttttcctttgctgtttttaaaattattcctttgcctttaacttttgacaatttgactataatgtgacttggagagaatctatttggagtgaatctatttggagttctttgagcttcctggatctgagtgcctatctgttcaacaggaattgggatgtttccaggtattattccataaaatatatttcatacaccttttccattctcttctccttctggaacactcataatgtgaatatttgtcacttaatggtgtcccataaatcctgtagtctttcttcattctttttttgtctgcctgttatttcaaaagacttgtcttcaagttcagaaatttattattctgcttggtcttgtccattgttgaaactctcaattatattgtttaatttcattcactgaattcttccattccagaatttccacttgatcctttttaattatatctacctttttgttgaatttcatgtacatatcagaaattgctccttgattttgttgaattgtctatttgtattctcttatatctcactgaatttccttaagattattattttgaattcttttactggaattttgtgtgtttccttataactggggtctgttactagagaattattatgttcctttggaggtgtcatgtttccttgcctgttttgtgtttaatgtgtccctgcattgatttatacatatctggtgaaacagtcacctcttctaattttatggagtaggtttcatatggaaaaacttattcatatagatgggttttggggtgttggtttgatggggtgcattggctttgattctaagtggacacagtagtgtagtctctatgtagtgtcttcaactataatccatgctagtgatgtttgtctcagtggcctgggctgagagagtttatggcagtggtggtgcagctttgctagaggtgggctcattggtttgtttcttaggtcaggggcatatgtgtgcacacagtgggtgagccaacttgtggtctggctttctggagttgggaccgtgggattattactctggctgggggcacagacacacaattgcttggctgacctgggatcatgcctgccaggggcatcatatggggctatttctcaggcctgggacagggacacaaggcctcttggccagcctggaaggtatcttcctgcagcagcccacagggctatttttctggcctgagatgggggcacatggtttctcggctggcctggggatgtatcagctgcttagtgcctcagggacctctcccacttggggtagggcatgcagtggtttggctggcttaagagtgggttcaccctgggcaggactgcaaggccgtttgtcccactggaaatgtgggcggtgaagggtgggtttcttttttgggctcatcctgagtcacagctaactctgggcctggaatctacacagctggggttgtgacattcagacactcatgtgggcttggtggaatgaatatggagcgctggtgctgtagaggtacagttgcgactgatctccagagcataacacactccagagtgtggctctggtctcagaatggtgctgtcctgcagtagcttggctcacagtgggtgggtatgtgtgggtgagagcttggctcacaatgtggggggtaagcaccttgtgctactaatctggaacaatgcagttcagtgaaatccttgcagctctccaaactgggctcagggctttgtgaggactgtgggagtcttgtatgtaaggactgtaggtgtttgcagtggcaatagggactgttagtgatcttctgcttacctttttcctgcaatggaaagtccctcctgtctctgggctgatcagatccaggcaggggagatggggtgcagatgcacggtgcctctacactgccctcctgggcttctagccgtcacaggtacttctccattcctctgctgcatgacagcattctcttttcaacactccagttaaagcttagttatttatttgttgccatgattctttcttcgtgggggtctgggagagcaccagacatctctagtcagccatcttgctgatgtcactcccagaaacatatacttctgagtctgaattgttggtaagggcaataggtggttattagaccttctagatttgccttactaccatgagtcaaatatagcacactgtctgttcttataaataaagctttgttggcacacaaccatgctcatttgtttaggtattatctatggctccctttgtgttccagcagcagagctgagtaattgcaacagagaccccacagcccacaaagccttcatatttactttctggctcttcatagaaaaagtgtgcttgactccttctctggggaattctatttggaacctctacatcatatcagacatcttaagatgtattcataccttacattaaaaatgaacacattgccatacaaattttgaaaggttttaaataaatttgcttttgactatgggtaacttatttagcttactactggctacaaaatgtcagcagttttgcttatttgtgaattcctgcattatgagatgctctctgacaaattgttttcaatagtaataaaatattcatgcaatactcatgaacaacaaatttaacaattaatgaggtaacaaaatatcatgttttatagatatttagttagacatttatgaatttttagtttgctgtcttctttgtgtattttgaagccgatatccttatctgtacacacacacacacacacacacacacacacacacacacacacacacacatatatatatatatatatatcctgactattttcataggcctttcggtcttggaattatagtgtccagtgaagaaaatggtcatgttggcatctttatgaagtacccctggcataggatatttcagcctttccctttacatgcaagtctatattatatattatcaccttccccaactgatgtctgcaggagacattcctggatgtctgctggtcctcctcccaagttcattctcaagtctacctacatgcttaaagaaagcatccattagaaatatcagcaccaggaggttttggtgaaaattcctagcttgtaatggaattcacatatactcatgaattaaactaattcttgctaacggcaatgaataaggcaataaacagaaatagtaaatattttcagagaaaatgtgattttattatgaacattagcctccaaattacccagcagtccaaagatagcggcagtctgagaagttaaatatttattttgcatttcatcaattttggtttttatgtgcaataacaatctgattggttttgtggagcttttcatctaagatgttcattgtgcttacttttatgatttactaaacacagcagatacctcagttgttaaaactttccttttcccaagtgaaacactgaccgaggagacctcattgtatgtttctgtgaagtaggcatagcaacggtcccctcaaagatgacctgtggcagccgtcaaggatatcaagacagtgccaaatagagggcgtttctaagatggtttcctctcatcagagagtttttctgtgtggcagagactgcaacccttgtctagtcattgtcttctctgaaatttgtgtgtcaaaggccaaacaaatctgctatgaagaaggagaaggataaagaattctggagccatgaaaacagtcctttcactgttcccaacacaagcattctactgctgaaattttgtgcaagtatgaggctgcagagactgctgattgccctaaaacatgttacctcttcttccccagtaaaagaaccctgattcttgctgtgcacttgccaggcagaatggcagcaacatttcccatcctccacttcagctaggcatggctatgtgactaaattctggccaatgggaggcaacttccaggaagtgtccttgaagagggtggagatgtgtctgtttccctcttcttctactggctggaattagaatgtgatggctggaggtggggcagccattctggtcactgccgtcagagctgatacacagtgtagtgcaggatagaagaggcagaggtgcctgtgcaccagggagccctactccactcctgaaccaccttcctctagactcaaagtgaggaagaattaaatgtgtcttgtttaagccattgctcttttggattttctgtcattcatggccaggtctaatcttaactgatacaaaatagagaccaagagaagtgagctacaagtagcagaaccgaagcacgtggccttggcttaatggatgtgttcaggcggcaggggctcaaatattgtgagctagagagccagtgacccttgttatacagaaacaaagcatttgataaaaaccactgcccattgttttttgaaaagcagcccatgtcctgaataaggactgaggcaggaaatggcaggagaaatttataatgttaaaaaaaaaaaagcattagctgcttatcactgcttttagcaatgttctacaagagagagctggactttggctactgctggccagtacctgagcaagaatgaaaggaaacacagtgtgctaatggaggcactctacctgcagtctgcaatttaagttgactgagagcttggtaatttggagccttgcagggttgaaaaaacaactgctgtgtttcacaaactatatcagtcgtagaaatggtttctgcaaagcagcctgcttagcagaaaataaaactagtgccccatcctgccaatttggaaccttgtgtcaaaagtcatttgaagggttttgtcttcccagctaagcccttccttcccatggctccaggtgggtaccattatgctgacagagggagagagagagagagagagagagagagagaaatatcagcagagcatggaggcccataaggaaaaaccagaagtttcagcattaaaaacgtgtcttcacagaagagctcaccggaaacaagtagatctgaagtctttatgtttttgaaaaactgttttaccaaagaaaccagcagtttggtctgtctgcaaaagcttgtgattgtttaaccccaaagtgattcctctggggggttggaacaaccaaccttcaaagcaagaagcaaactgtgaacgctgtgtagcctcaggaagggcataccctttgccccccacactgggtacagcaggggagataatagtagggaagagcctctgagaacacaaggccatggccatggcgggtgatgctacagaaggagactccactcttcctgcccactgggatttgctcacgtgtgtagatgatgatggctgtgtttatcagcctccaactaccaagtgatagttttagtcacagctcttctgttcttactcatctcccttatgttggatgtattgagagcaagtaacttattacttagtttgtagtttgtcaaaccattaaaatcctcattcatatctcagagaaaggactgtgctttaccctgggttgccagatctagagtcagatgcagtgattggatggaattttgcagatgtatctcttgggggcaagagatgagcatgttctgtgtatgggaagaaaggctcacacaggtctgtgggtggccaaaggagtggactgtagcagaaactactatctccccacccactcccatgatctcttctttccttattcttaagaaataaaaccctgaatttagccagggctatggctttcccaaatgtacaatgcatttctcagacttccttgacctagctgtgaccaggtgactaagttctggccaatgggattcatgtagtggcagcagaggtggtcgtgcaagttctgaagggtcctgcagagagcaggtgcgccctcctctgcctctcctccctctccctgcaggctggctgccgacctgaagggggactatctgcagagcttgggaagggaggcatccacagtggaatcctgtgttggaaggagccagagtccctcacactggcaggccaaaaaggcctggatccccaaacttttacaaaagagaaataaatgtaagtcagcagttgtgggggcactgtgttctgtcattcatcgtcgaacttaatactaagtagccccagtaatgtggcctaaaaaacaaaccaataaatagaaaaccactgatgcataaacgtgtgctatgctttagagtgattgcctcgatgagttaaatgcattcagtgaacagatttttcccattatgtttaaacaagtatatgtacaatgagtgagtttcctccttacaccgtgctacactattgcttaacagattcctaaaattctcttccaaaatgcctgtcactgccccatggcatatccttttaaatatccctttccactgacctcacaatgtcacagtgtccttttgagcttggatttgatttttggaaactgccagaagtcctccagggccttcggggtaagcaggtgggtgatcagcctcagcgacacccttctgggctgggagcaggtgtggtgaagggcagatgaactcgttacctgagtcacaaggccattcattcccacatgggcctgtagagggtttgagcccttgggcatacctgttttaaatgtttttaaaaacttcctctctcagcccaactgagaggagtattaagcagtggggtaagtgtgtacctagatcgccaaccctgggctggcactgccagtttccccagcacctagactgccaagcactgactccagctaacactgtcctttatcaaaacacccttaaaccaagagtctgaaaatacaataaaggtgattaggagctgcttgcccctgatcaaaatgaacccggcgtagtgttgaatgctttcaatctaccgaaatggaccttatgtgctggacactatttcatttatgtggaatctgtggtgttagctttctcagagcccagagccaggcaccaggcctcactgggatgcatggcccgaaaaaggcttcattctgacttagaatctagtaggaggtgaagtcccacaaagtgactgttgccttaacccgctctgggaagtctgtgtttgctctggggtttatcgtttgtttccctatggggagcagaatggtgaagacatcctcccaagattcctgaggcctttcaactcatactctaatctggcattactgtgaaggaatttgcagaggggattaaggtgaataaccagctgattgtaaaatagggcattgatcttgcatcttgtgtgtgggcccagtgcaattctatgagcccacgagagtggagacagctctctggctggagttagagagagagagagagagagagagagagagagagagggagaagaggaggcagaagggaggtgaggcagaagggacttcacagagaccggaagcaagaaaagcactcaccctgccattagtggctttgaagggggccacaagccaaggaatgtggatggcctccaggatctgagcatcccctcaccccactggtgattgccagcaaggacacaagaacctcagtcccacaaacaaggacctgcatttggtcaagaacctgagagcgcttgggcatgcattctcccccagagcctgtaggaaggagtgcagcctggctgatgccttgactttggctctgtgaaactcagggcagagaacaagctgaactgcactgtgcccacacttctgacctacagaccctgtagggtaaatttatgctgcttttaagcagggaattttctggtaatctgtatgacatcaaaccttagcatgaatgtaaacttccacagggaagctttgtcaaggcatctccagtgcctggaacagtgtctggaacagcataagtgctcattaagtgctcactgagtgaatgagtgatatggcgactattggtatgcggctcctgcaagaaggctggagaagacacgaggggccacagcagcaaatggagccaggacagcgtgtatgtgtgtgtgttgaggggcatgcggagggtaggggcagtaggtggtcacttagctctctggggacagggttatggtcttgggcagaggagaagtagtgctgatgtgatcacaagactctgattctgtcccctcagccagtaggggcctcaaggtcactgcttgtatatggctcaggtgaaaaagaaggacagtggtgggagggtgatggtcatagggtcacatttgaatctctgttgtttttttccctcgatatagaaaagttgaaagaattgtacaatgaagtcatgcatacctatcatctagattctgtagttaacatttgctatatttgctttaacacacatcaatgcatctttccatccctcttttttcttttcttcctcttcctcctcctcttcctctatatcctctttcttcttctttcatcctattcttcgatgtgtttcaaagtaagttgcagacatcagtatactttacccctaaatactttgcctaggtagtgttgagtttgatacttttaaaggtaaaatttacaaatgaaatgcataggtcttaacttcaccattccatgagttttgacgaacgcactcaactgtgtaacccacatcccagagaggtatagactattgctggccgacagcaggatctgcagtgatgaaaatggtcggtgctgcccagcacagcagccaccatgggtggtccctgagtactggaaatgtgtctaccaagatggaagacctgaatttttgattttatttaattttaaataatttaagtttatattctatgtgggtgacctgctaccttttaaaattgaaattttggttggaataatgatagattcacatgcatttgtaacagataatacaaagaggtctcatacccttcactcggttttctctcagggtaacatctgaccagacaactggacagtatcacaaccaggacactgatattgaaatgctccacctaccttactcatgcttcttggtttcacctgtgctcttctgtgtatgcattaagttctgcactgttttgccacctgggtaggtctgtgtaatcatcaccactgactgatgctgaacaaggtgctgagcagggcagcacccccaggacctccaggctgctccagtataaccacacctgttctcctcttcccactcactcttgcaaccactggtgaccatcagctttaaacatttttaaaatgttttcacttatgtaatgtgatataaatgggattatacagtatgtaatcctttgagattgggttcttttgatctgccacgtttttaaaagcctgtcttccccactgggactgcaggctccttgagggaaggaactggttgtggctgaatccccagggcctgacatgtagtaggcactctatgtttattgatttagcgagaggcaatccaaataaaaaagcatttacgtgccagtccctgtgatgcagagggggcagtggagggagagaaaagcttgcagaaggagatgattcaaaacgctgagcagggagttcataggcaggagacattcagagggacacagcatgggcaacagctgggaggcagggctgatcaggaggctgcagcctggcctgtgaggatagcgtgtcttaggctgacatggcaagtgaggttgtggagacatctgaaccctggtacactgctgattggaatgtaaaatggtactgctgctgtgacaaataatatggatattccttaaagaattaaaaatggaactacagtaggattcagcaatcccatttctgaggatatattcaaagaatagaaatccggatctcaaacaggtatctgcactctcacgttcgctgcagcgttattcacggtccccatggtgtggaaaaaacctcaatgtccacagataaatgaacaagtaaagagacgcgatatagacacacaaggggatgctattcagccttccaaaaagaggaaatcctactatttgcaacaacatggataggtctggaagacattctattaagtgaaataagggggacacagagggatgaggattggaaggtttcaccgatgtgagtgatcaaaaagagtcagatgaaaatgcagaagatagaatggtagtttccaggagatggggtgggggagatggggatctgtttgtcaacgggtataaagttacagttacatgagaggaatcagtcctagaggtctgctgcacaacgtggcacctatagtcaacaacgtagcacctatagtcaacaacgtagcatctatagtcaacaacatagcacctatagtcaacaatgtagcacctatagtcaacaacgtagcatctatagtcaacaacgtagcacctatagtcaacaacgtagcacctatagtcaacaacatagcacctatagtcaacaacatagcacctatagtcaacaacgtagcatctatagtcaacaatgcacttcaacattttactttaagtgctaggatacatgtgcagaaggtgcaggtttgttacataggtatacatatgccatggtggtttgctgtacctatcaacccgtcatctaggttttaagccctgcatgcattaggtatttgtcctaatgccctccttccccttgcctcccaccccccaacaggccccagtgtgtgatgttcccctccctgcgtccatgtgttctcattgctcgactcccagttatgagtgagaacatgtggtgtttggttttctgttcctgcattagtttgctgagaatgatggcttccagcttcatccacatccccgcaaaggacatgaactcattcttttttatggctgcatagtattccacggtgtatatgtgcacatttaaacatttcttaagagggtaggtctcatgtcaagtgtccttaccaccaaaaataaataaatgaataaatgaataaataaataaataatatataaaagcaaaggaacacatggtcactgagagacaagagattcagtcttcactgaggttgaaaaacaaggaagggagaaagaaagtgaactggggatcccttctgccaccttcccccacaacccctggttttattgaggtataactgatatgttaatataaaaaaagacatatattgaatatctacaatctgatatgatagtataccatcaccagaatcaagttttgtggagctctgctacctttttgctgggtgacttccccagtctgggcctgtgtctatttgaaaaattgaggattcattttgactggagggttttccacctgagttctccagagcctcagcattccaggacatcagggtgatttgaagtcaatcacagcagagaaactttggtctgttggtgttttaagtatctgggtttttttttgtttgcttttttttgttttgttttgtttttgtttttttcagtatcccttcaccttcttctaggaaaacatctggacttcctttgggtagttccccatctcttcatcctctgtttctgtaagttccagaggcagatcctggaagattttaactagctaatgtagcccaccccgttggccaccactattagttcagagatgtgcattttacccaaactgagccagtgagagtggggcccagggtctttccaactctttggatggactttgaagctgagaggctgtaagtgcaggggcagttgcagcaaccttgagaacatgaggggaagaggcagagtggttgggggccaccagatgtgggaagcatggaagtgagctgagagggagtggagtgggttctaatgacattgcttaagtcctgcacctagttaagaagccatgactccccttggacaattacctgcaccagtgaattcacttttgtgcttgattcaagtttttggaaaccagcccggagtgaaaacatttccttcaaaagtttttgtttttcaaagtgaaagcaagtttattaagaaggtaaaggaataaaagaatggctactccatagacaaagcagcctcgagggctgctggttgcacatttttatggttatttcttgatgatatgctaaacaaggggtgggttattcatgcttcccctttttaggccatgtaggataacttcctgatgttgccatggcatttgtaaactgtcatggtgctggcgggaatgtagcagtggggatgaactggaagtccagctttccaggagaaccttctaatgagcacctcttacctgctttgtgtagtctaaagagagaaatcgcttcagcctcagcaggggctgcatcatcccccagggaagagccacagctgggcgaggattgccacaagacatttacaaggagatgatgccacggagactaacgcagactggtaaacggaaacacggggctttggctcgaacaccctctttcaagaaagttgtttatgaccacaaggaaggtttgagtctctatatttttgcatgtactagatttctccttttaaaaaagattcagttatgaattcaggcgttcaagttaatccttgagaattaaatcaattgaattaattatttgtaaaaacatcctcagtttcttcagatgaaaggagtatgatcttcacagaattctgcttgtaattcccagagcagttgatgtattttgttgtattttgctgattggctttgtgtgatgtgcaaagttctttacagagaggctgggagagagttggggggccaaaggtgagagggctgtgttcttcccacgctggctcacagcctcttgggagtttatcatggagctgggtggcggccactgtcttcactttcccagtttctggttttgttttttaaagttttcatcctcccactttggaagcctatggacttcatctgtcatgcgatttgtaaatcaagaccccaacaggcagctgtctgcttctattagctttcatgacacaggtgacactgcatggaaggcctgcctctttctttaagtcagttattaatatgaaatgacaccaagttgtttctcaaaagccaaacagcctaagaatagtaaagaaaaatcataatctcacagtattataattcaataactatcattattaaaatggtggcataaagcccaagctttgcaatgtgtgggggaagttgagtgagaaattcaccctgaaattcatctgtgtatcagtcggagaaattaatgctggcagctgaaacaggtaaatccaccaaggcttttaacccaatgaaggtttatttatcatcaggcaaagtccagtaagtgcacaatttgggcctgtaggttggctgtggcaggggaaaagatgaagaaagcacagtggctattaaattctattggccagaactagtcctgtgaccatgatctatttgccagggagacgaggaggtgagaatgaacacatagatactgaatgcatgtggttcctctagcaatgtaaggcggatttctactgttgttagtcagaaatgaaactcaaaactcatttagatgatggaattacgaagaacttgaatgtgggcctaacataaatcatgctgctataaagacacatgcacacgtatgtttattgcggcattattcacaatagcaaagacttggaaccaacccaaatatccaacaatgatagactggattaagaaaatgtggcacatatacaccatggaatactattcagccataaaaaagggtgagttcatgtcctttgtagggacatggatgaaattggaaatcatcattctcagtaaactatcgcaagaacaaaaaaccaaacaccgcatgttctcactcataggtgggaattgaacaatgagaacacatggacacaggaaggggaatatcacactctggggactgtggtggggtggggggaggggggagggatagcattgggagatgtacctaatgctagatgacgagttagtgggtgcagcgcaccagcatggcacatgtatacatatgtaactaacctgcacaatgtgcacatgtaccctaaaacttaaagtataataataaaaaaaaaagaatcacatttccaatcctggtgtctcatagaggatcaaaaaacagtgtatgaaagacgcatgatgtgggcatttagagcattggctttggtttgggaggaagccagggcttaacaccagctctattattcaccttgtgtgagcttgattaagtgtattcaacactttgagtccttattgctttgtcggtaaaatggggaaaatagtaacacccctcttacaggttttttgagaagtcattgctattactcttaccaccatcactgccccgggaacttgtctttgtaataagatttttggtggatctgaagctgtgggttattgtttaacctccttcgtgtacacaggctgccttccttcatgcatacatgcacgtggcaaatacttatcaaatgcttagtgaatgctaagcctgtgttaccattttgcctacgttatttaattctcactttctgttttcaccccattttgcagatgaggagaacaaggctgggagaaagcaaaggagccacttgtttaaggttatgcagctgagaaatgaacaaggtggggttcgagtccagagtgcgcattccccatcaccccttaacaaaaaggcatgtttcccaggagactacagaggagaatcggcaggtggtcacaattgcagggctgtctcaggctgagcagagagtacggtggaggggcatgggcctgctgttggcggtgagggccttggaaatggcttcctggaggagatggcaattatccaggtagacaagatgtgtgtgtgtgtgtgtgtgtgtgtgtgtgtgtgtgtgtgatcatgaagaagaaataatgtgcaaagccctggtcataaataacttttcctctgcaaactgtggatggcagttcaccatgtttctcaccactggcctggtcactgcttatccaatatgcatgtaagaattactttttctcttttttcccttctataaattctcatagaacttcctttaatgcattaaaaaagcaactagcatgttcaacccatgatatcatatatcctatgttttaggatgcaactaaagtgaatatataggtgaagagggtgaatcagtgcagccggcagcacagggaaaaccaggaactgtcaatatagcaaaggtgggaagcccagggagctgaagcttcaggaaccctgggacagagagtgtctccctgcattccagcttagaagtgctgctcttcaagacagagtgtcaccagctccatttgtccataaagccacattgttcgaagggaaggcaatgtccctctgccactgctcaccatgaaaagacagtgctgtgtcaggaactgtggggccagagctttgtgctctgggggaagggtcatgaggcaaaaggtcacaagagtagccaggaaagttctaaattagccttgggaacaagccaggcccagagcagagacccagagttcaggaatgttccctggccctgcccttgaagtctctgctcatagcctcggagccgtggctaccagggagggtggctaaaaataccttggtcaggggcctagagattgcacttaggagactgctttccagaggcagcccggggagagccgacagcagtgtgggcgccagggcccccaccagctacaaaggtcagccagcccccagctgccttcaggtgggtgtttctgccagttctcctttagtgttcaggctcaaatgaaaggccactttcagcaagttttcctgacattgtcggagactggagccaaggccctgtctgttttactttctgaaagagccagtctgagagatggatgggttggcgactgaacaccacaaacaacagcagtgggctttaacctgatggtggaggctccggcacaggtggggaaggccagtggctcagaaggcctgacaaggacaggaccaaagctccaacagctcagagctggactccttcccatcccagatctgagctctttggttctccttcacagaggtgattatggttcatagtatcttctaaatagaaatgcatatcatttaaaatttttaataccaatgtgtaaactgaaccacactttaatttattcacctaacaatccacctaagagatcctgccctgtcaacataggtatagttattgcactttttagagtttttatgtcattgtttgtacgactgtgttataacttaagcagttttctgctgagaatattcaggctatttctggctttttgctacaacaaacagtcctgctgagaacattctaattcacactttttctatgcatgcatgaacatattgttaggatacagtcctagcagtgaaattcctagaggaatgggaacatacgtttacaatgttaatacctattgacaaattgttttccaacattcccaccagcagtgtgtattatcagtttttaaatatttaccagcctaagtaaaataacttaaaaagggtctgtaattttagtcttaacctccataactttcattataaatgaagctggaacatatgaaattatgtttatgagccacttattttcctgtgaactgcctgtttttgtcatttacccatttttttttttctgataggttggtggtcctttttatttatttgtaggaatgctttgtatgtggtatggtttggctgtgtgccctcattcaaatctcatctcgaattgtgatcccacatgttgagggagggaggtgattggatcacggggggcggttcccccatgctgttcttatgataatgagtgagttctcacgagacctggtggttttatttggggctcttccccactttactttctcttctctctctcctgccaccttgtgaagaagagcatgtttgcttcccctttcgccatgattgtaagtttcccgaggcctccccagccctacagactgtgaatcaattaaacctcttttgtttataaattacccagtctcagggaagttcttgaaagcagtgtgaaaacaggctaatacagtatatgaggatattagctctgtttgttatctatgttacctttttttcagtttgtcctttggtttttgatatctttttccatgcaaaaactaaaaaaaaaaaaaaaaaaaaaaaaaaaagatgaagtcaaatgtatcactcttctttatggctttaagaggacactgatttctgaatggtgagaaaaggaggtgacaagaaacttctgcaccttcctgcaccaaaccagacttgaccctggaacacagcaatctgacctggctgcgtgtttcatgtgtggtgggttgatggcccatctctcatcctggtcactgtcacctctgtttcctacctgcttagcctttaagctgcgaagtcatcctggacatgcatcacctccccaaactctgtcttgtccccattgccacccttcccccagcctctggacaaatctccctgcttcagtgtctctcatctgttgggtacaaacatccccagaagatcccccgccacacattccctggatcagaacccatcagtggttccctagtgcctgggaatttccattcaatggcctccgaaccatgagcctgccttttctgcctgaagcccaaaaccccagctacagatctttaccccagagaccatcttgggcctccctccaggcttttgcttactctgtgccctcatcctggagtcctgtccccacccctatctacagaaactccaccagccctcctggctgccccgatggtcctcgcacagggagacttgtctacctcccgaggtcacgtgtgggctctggtcctcttgccatcatggcagagattttgctgtatctccccctggctgctggtgctctgcttacctcctccagagttgttaacaaagagctgaggatgctgagctgcccagggacttggctgcaggtggcatagggagcagcaagggctggccagcccatgagctacacgcccgagtcagctgcctcctctgggtaatgaagtggaaacgttgctctccacctgccacctccaggggctttcttgctctctcaagtgattctaaccactggtcattcttagttaccaaccacagctccaacactgggcaccagggatgctgaagggagcaaaaacaatgagcctcccaagaggtgagatggaaattaatctaataactacacagaaaaaaatgcaatcataactacattcagtgccacacaaaaggtttgtgaatcaggagagtgtatctccaggggtctgacgtagtctgggggttggggaagccccacaaatgcccgagctgcctgtgagtatgaacagcgaactggagggggcagtgtcccagtggagggacagcaggagggagcctggtgcacccgtgactcacacggctggggagagggctgaggaagctccagcattcctgcttcccctgatcttgcccttcagagggtttgaggctgaaccagtccctctttgagggaagaaagggaagatgtgtcccctgcctgacaattgacaaacagagcacattcctttcttggttccaatgtcatttgcttgagaacaaatggaccaaggagaggtggcagagcagggatcctccagcagtgagttgtgctggccctggctggtgtttcaggatagggtcctggtgaaaggtgacagaggtacagccattgaaccacaggctcctctcccgatggtgatcctcaaaagggaggctgctcccaggtggggtgccagctgcaagggagcctgagagcataggcgaacactggaaacagaacatctggggattcttctgtgccttgactttctgtattcttaatatctcgatggcagagaaatctgagatcaaggctaaatatttgcctctgcttcggattttgattccactagaaagacagttgaaataatgtacatttcagcttccgatgaaatagccagcaatggaggatctgtgtttgtttgcgaagtttactcacccaataaatcattcctttgcagagatgccattaactaataattcaaggttggtaacctccaatcaacagtgattaaagaactttcgctgaatggcagagagagaacacgtttttctgaacgctagcagcagtcggcttgcaccatccatcttttctttgataaactgctctggactaataattccagatggaaagattttaaatcaagtacggaggttggcaggatcagggaaaactctgaataattgtaaagactattttattgcagactcttttcagatgggagacagtcacctaggttctcaagagtggatggtgtttccaggaggggtatttcctcctcacctcttattcatactctgtgggcactccacgcccatcgcatgagagtttaactgtgaagtgtggatttcacatgttgcattcctgtcatcattgcccccaggacggaaggccagattctgcacttgacaccctcaagcctatctcttccacactctgcctggaattttgtgtcccaatcatactgaggttttcctggctctttccttctcagccttcaggtgccagcagggatggtcactgggccagatttctcctctgatccctgcagtgcctcacagaaccactggaaaacacactgcctcctggcttgtctgcccctcctctaggctgtaggcgagctcactgggggccagtgatgtgtcttatcttcttctgtagcctccatactcaacacagtgctggtgagaggtgaaaccttcatcaatgtatgttgcactaaagggtgaacgaacacaccccttgatgttttatgctaacaaagggtggttgcaggacagaagtaggtcatgaggggtggaacctaacctaccaggcaccaaagtctctggggagtgtgttaaaatgcagatgctggggtcccacctccagaggctcattcagcaggtctgggctgaggccttgggaatctgtttttctggttttttgtttgtttgttttttgttttttttgtttttttttttttgagatggattctcgctctcttgcccaggctggagtgcagtggtgtaatcagctcactgcaacctccacctcccgggttcaagcaattctcctgccttgtcctcctgagtagctgggattacaggtgcccgccaccacacctggctaatttttgtacttttttagtagagacggggtttcaccatgttggccaggctggtctcgaactcttgacctcaagtgatccacccgcctcagcttcccaaagtgctgggattacaggtgtgagccactgcacctggctggaatctacatttttaacagtcttcacaggtgactggagttcctgctgaaatttgagaacctctgctcttaacctttcttctttgcctctaaaagccatgcctgtgaccttgagccttgtcttacctttctaactctcttgtgttgagggcaatggtgacaagagcctctggactttgaatgctcacaaataaacagtgggaggcatgtgggaagccctagaaggtctggatggccaagggagcctaatttcagatggactatagtgaaaattgcatattcattcattcagtcagcatacatttattgagcatctactatgtgtatcaggaaggaccaggagctagagaaaaaggtaaatagggatgacagagtccacagaaacccgcaatctggtaggctctgggttgtataactcaatgagaaagtgaagaaggtgaaggccttacttcaccacaggcggcaggtgggtgggggggagagtaccccatcgccaaggtctttgtctgaactcactccctgctcagggcaggcaagaatcccctttccagaagtaaggctgtgctgaccaaagttggctgagctgttctgtaacagctgcaaagcccatggtgtgaggggctttctgtctcattgcagcttcattgtggggatccatggggaaatttattatgaggtttagcagacattgctcaggccaccccagacttgcctctcagtttgggcaatctattcaaccaaactgccgggcaaacaattgcacattataattaggagagaccttaggggaggtcttctatgaggggttcatgaacctttgaacaccttgctactcaacgtgtggtcactggaccagcagcaccagcattctccgggaacctgttacaaatgcagaatctgagcccccaccccaggcctgctgcaccagaatctgcaattcaaaaagagaccacgatccccaggtgatacatgtgtacattaaggtttgagacccactggtctattgaatccattgggcaaaatgttttgcattgtctgtgagggatcccggagttctcgtgtgattttcacattgacctgtgactacaaaatttaatcgctgctttggagatgtgtgaagtccagggcagtgttgataaaaggttttgcttccctgatcaatccctgtgagtgatttggagctagagatttcttctagggttatacattatgcaagtatggaagatggtgaagaagtctatggaaggctgttgtctccaaacctggtggttggcctgaactcaccatagatcagcagggctgagagtctgagagacaggaagtaggggagaataaggaaaacctggaatgcacaagggacaagaagaacccagatctgtcacaggtgacctgcagaaggaagctgccaggaggctgctctgctcgcgcacctggcccaggactcactggagctggaagagctgcaggcctggcccataatcagcaacaccgagcaggtgcttcaacatcgcccagcccttctgagcctactggatgtgccttcacttctgccttccagttcactacaggtttcttttgtggccaaccttggcctggaaacataaagcagaaagaattctgggaagcacagttccagcttagatattgttgctgcagtacaagttgtcaaactcaaccttctcctgcgctaggtgagtactgtaacgagcggcggggctgggtgaggttgtgagcacctggagagtgaattgctttacctaactgtctgccagaataaatatggacctggagctgccagatctttgaattttttaggataaactagaatttggggatattatgtcaaattccctttttaaaatggtagaaaccaatttgatttttgaaaattattaaccaagaaaaatggttctgatgaaggggtggcctgcccctcacacctgtgggtgtttctcgttgggtgagatgagagactgagaaaagaaagagaaaaagagacaaagtatagagaaagaaaagtgggcccaggagatcagcgctcagcatacggaggacctgcgccggcaccagtctctgagttccctcagtatttattgatcattatctctaccatctcggagagggggatgtggcaggacaatagggtaatagtggggagagggtcagcaggaaaacatgcgaacaaatgtctctgtgtcataaacaaggttagaaaatgtgctgtgctttgatgtgcacatacataaacatatctggtgcattaaagagctgtattgccgccagcatgtctcacctccagccttaaggcagttttctcctatctcagtagatggaacataccatcgggttttataccaagacattccattgcccagggacgagcaggagacagatgccttcctcttatctcaactgcaaagaggccttccttcctcttttactaatcctcctcagcacagacccttcacaggtgtcgggctgggggatggtcaggtctttcccttcccacgaggccatatttcagactatcacatggggagaaaccttggacaatacctggctttcctaggcagaggtccctgcagccttccgcagtgttttgtgtccctgagtacttgagattagggagtggtgatgacttttaacaagcatactgccttcaagcatcggcttaacaaagcacatcctgcatagccctaaatcctaaaccttgagtcacagcacatgtttctgcaagcacagggttgggggtaaggttacagattaacagcatctcaaggcagaagaatttttcttagtacagaacaaaatggagtctgttatgtctgcttctacatagacacagtaacagtctgatctctctttcttttccccacatctgtaaactagacttttatcatttttattatgcccatttccctcattttatggctgtataaattgaggctcagagagggcaagtggttttccaaacatagaacagcaagtgtaatggctggactggattcagagccacatgccctccaagaaccctttgcacaacctccatctttctactgaggagtttcactaggcctggcccccagcctggagggtagagaagatttatttagctctctcacagacaatgcgaaacatttgcccaattaatttcttaattgctccccttaaggtagtgcttctcgaacttcaatatgcagagaaatcacctggcaatcttataaaaatgtcagattgaactcagcagttctggatgaggcctgggattgagaacgtcttgcatggtcccaggaggtgaggaacactgtcttcaggagctaacagtcccgctgggtcagggagcttccatgagatgactagagctgcacattaggattacctggagagatttaaaactatcccattgctgggctgcgccagagaccactgacatcagaacacagatgggtgaagcccaagcctcaggatgtttaaagtccctcaagagattccagagtgcagctagggttgagaagcactgaattagggaaagttggtatgaattttttggtgctagagggaagttcaggggtgggagggaggcaggaagggctttctagaagagcagcttctagagtttcccaagggaaggccctagaacggcactgtctgggacaggagctatgagcccccagttgttatgggtcatctgaaactgcattgagcaaaatacacacttgatttggaaaatttggtataaataaaataaggaaaatattttattaatcactttgatattgactatatgttgaaatggtaaaagtttgaatgtattgggataaagtatatcttaaaaattggtttcatggtttccttttgatttttaaaaacgtggctattagaaaccttacaattacatatgtggcttacattttatttctcttgatgatctaaaatcttcatcattaataactccttgatgatgcttgtatattcaaaagtctaaacaccactgaggtagtttggaactattgacataacttattgtctgtggtccctggaccggcagcatcagcatcatctggaaattgttagaaataaaaatttatcaggtcccactgaatcagaaatcctgggagtgtggtccagcaatcagtattgtaacaagcccttctggtaatttctgatgcatgctaaagatgaggaaccactggtttacatttgtcaagggggagctatgatcatgccataggcaagctttccctgagtcttttcccggaggggaagagtagcagttccaggcaggcgagcattagagagccaaagggcctggcacctcccatcaaccccatagcaggaatggggcgaactttgattgatgtaagaaaatgaaaatagatttcctttgttgtgtagaaactttttagtttgatgtaatccaatttgtctattttcacttttgtttcttagacttttgagttcttgtccaaaattctttgcccagaacaatgacatggagcatttcccctatggctatgttttcttccagtagttttatagtttcaggtcttacatttaagtcatttaagtctttaatccattttgagttgatttttttgtatggtgagagataggggtctagtttaatttttctgcatgtggatatccagtttccccagcaccatttattgaagaaactgtcctttccccaatgtgttttctgggtgtctttgtggaaaatcagttggttgtaagtgtgtggatttatttccatgttttctatcctgttctattgacctatttttaggtcaataccatgctgttttgcttactatagctttgtattatatcttgaagccagatagtttgatgcctctagctttgttctttttgctaaagattgctttggctatttaacttcttttgttgttccatatgaattttaggatttgtaaaaatttctgtgaagactgttactggtgttgtgataggaattgcattcaatctgtagatcgctttggggagtatgaatattttaacaatattatttattccaaatcatgaacatgggatatttttccatttatgtgtgtcttcctcaattactttcactgatgttttatagttttcattgtagaagtcttccacctccttggttaaatgtattcctaagcagattattttatttttgtagctattataagtgagattgcattcttgatttctctttcagatgttcactattgtgtgtagaaatactactaatttttataggttgattttgtatcctgcaaatttactgaatttattagttttaacagtttttttttttttgatggagtcatcagggctttctatatacacaattatgtcctctgcaaacagggactatttgacttgctcgtttcaaattggaggccccccttttttttcctgtggcctaattgctctggctaggacttccagtgctatgttaaataaaagtggtgaaagtaggcatctttgtcttgttctagatctgagaggataaggaaataatcaacagagtaaagagaccacctacagagtgggaggaaatatttgcaaactatgagactgacaaggagttaatatctacaatacataaggaactcaaacaacttaacagcaaaaagcaaatacagccggccctccctttctgagggtctcacatctgtggattcaaccaaatgtggattgaaaatgtagtatttgtgggacttgaacattggaggattttggcatctgaggggggtcctgaaatcctgagggatgactgtaatagattaataaatgggcaaagatctgagtagacatttcccaaaagaagacatacaaatggccaatcggtacatgaaaaaatgctcagtttcactaatcataagataaatgcaaataaaaactacaatgagatatcacctcacccaaattagaatgactatattattaaaaagacaaaaagtttcaaatgctggcatggatgtgaagaaagggaacacttagacactgttggtgagaatgtaaattagtacaaccattatggaaacactatagaggtttctcaataattaaaaatagaattatcaaatgattcagaaattccaccactgaatatttatttaaaataaatgaaatctgtatatctaagagagattcaaactcctatgtccattgcagcactattcacaatagccaagatatggtcaaccttactgtctggcaatggataaatggacaaagaaacacacacacatgcacacacacacacatacaaacacacacaccatagaatactattcagccataaaaagaatgaaatcctatcatttgtggcaatatgggtgaacctgaaggacatttgttaagtgaaataagccagggacggaaagacaaataaggcataatctcactcatttgtggattctaaaaaagctgccttcatagaagcagagcatagaatagtgtttaccagaggcaggggagggtaggaggaagaggatcatgcagacagattggccatgggtacaaagttacagttaaataggatgaataaattctggtgttttacggcagaatagagtttgagtcgaaagtataatacacatatgagttttacctctactttggggaaaggctttaaagccatattgaatagcaaaagagaaggaaaacaaacatcctctactggcttttgaataagctctatgagacctgcaagttactggacaccaaaggaaaagtgattttaaaacgtatcacattttgaatgccttccaagaagaacggtccagtagatgatggatttgtggctaagatcaaggggattaacagcttcttgggaagtctcccaggaggaaggctggcccgaggggatcagaactgctcccagtggaaagtagatgccacagtgatgtagctctgaaagagagtgcaccaggacaaggagaagttcctcttttaaaaactagacataacacatgctggttgcatgaggaagtggaaggaaaatttattgcctaacaaaatagccattctgctaggaaaacgtttgttaggcctatttgtcatgagaggtaaagtatctagtgttgcctggaatggggaaatattggcaaagaaagccacattgttttacacaataaagtaaatgtgagtcctccgtgttccagtgtgaaatgtttttcactctttgagacagaaatattcctcaattctagtttacacttctcagtcttctgagaagtagctcctaaacacaattctttggagtaggccctgaagatagatttgaggcagggcatggggccccaaggaagaatgggccctgtgtgagagtgggtggcagggtgggctggcactggaggagagagcagcttggggctcccacaatgggctgtggctgaggggctgagccggcatcatcaggcatcttctggcatctggtgtgaagctgctttctgctctgctctgatctgccttcgtcatgctctctacagccctcctactccaattcatcatgagattttatatccactaacttggtaggtaaggttcacctggtgtaaactgtaccaggtggtatattgggaaaagaaacagaggcgctgccacatttgggacagaatggagcagccacaatagaaataagacattagtgacgttgagcaaagcaagaagacaggcaaggtgaccattggaaagcccagggcctccttctcccacttcttagaatcttcggaaatattcgggagggggccagatagtccacggagattatgtgtgttgcagggggtgggcgggggccagttattttgcctggatgctgaagggctggaggattgcaagagaagaatgcagctgaaggttagtcatggtcacggctgtggtgtttccagcagtgaaactgacagccatggaggaatatgggaatccactttcctggatgtataacctggcttttcatcgtgacattcaaagtaattcacagcaggaaacttaacacgcactgagctctgtcttcatcatatgaagaggacagcagtttgcccattttataggtgagtatcttgagtccttaggaggatcagggtaatgtattgaaagtcatcttaggagtcagtgacggaacaacaatgtgtgtgctctgacgatgcaggtctaacccagcaatccttgttaccattgcccgagtgtaatacaggaggttggaagtggctttataagaaaaaaaattatgataataataatgatgatggtgacggttatgacggtggtgatgaagataatagcagcgaatatttcaatacattttaacagctccttatttgccatacactaagctaaatcatctacttggattatttcttcaaactgtcaacaaactaatttccatctagcctgaaatttttcatgctcagtaccattgacatttgtggctggataattcttcattgtggggggccatcatgtgcattgtaagatgttcagcagcatctccggcctctacccactggactccagcagcaacctctcctttcctagttttgataaccacaagtgtctccagactttgccaaatatccgctgggggacagaatcatcccctgttgagaatctctgcagaatcccgcattcttttccatctacctacaagatctcacccacatggggatgcagtctcttcccccagtgcttccagtacttgcccctgggcagccaggtccactgtgaggccactcaattcattacatcactcatgttgaccatgaagaccctaagtcatcaaggaaggttccactgggtgcagcaaatgccactcaggtagtcaggaaaagtatgtgctacagttaagaaatatctctaccctagaagggccctcactattttgtgtttatttttattttagatacaaggtcttgctctgtcatccaggctggaatgcagtggtgcaattatagctcactgtagccagttttattcttaaagacctaagacgcggtggctcacgcctgtaatcccagcactttgggaggccgaggcaggtagatcatctgaggtcaggagttcgagaccagcctgaccagtacggtgaaaccccgtctctagtaaaaatacaaaacttagctggctatggtggtgagtgcctgtagtcccagctacttgggaggctgagacaggagaatcgcctgaaccagggaggcagaggttgcagtgagacgagatcatgccactgcactccaggctgggcgacacagcgggactccatctaaaaaaactacaacaatgacaacaacaacaacaaaaagaaaacaaacaaaaaacccaaaaaacctaaggccttagctatctagaaagtttgagccccaaagtagatacatttttggagtgttcctcataatcaagatcttcctgcatttgcctcttcagaatattttacaaatgtttgtttttgattttcctgattgcctgtctttccttgagggctgggttgtatcttattcatttgtgtgttcctgatccctattacagcagctggtatatggtagggactccgaaagtatttttacatgatgggtgagtaagtgcgccaatgattgcttagtaacaaagtaacaaaggtctttgacgattccaggagctgcactggagccagggctgctgcctgactgatcagccaaggtaggagctgaagtttcatgggccagcagcccaggtgggctcatgaacacatcagtcctgggtagtgtggtggaggtggggctgcatgaatccatccccaactgtcatatcccagtgtctgatatgtctgcacagctggaggcggctaagtttgacattgcttcaattttctcactagtaaaatggggatacaaatgcgtatctggcagggttatgatgaggattaaattggaaaaaaacaactatttcaattgtgcttgacagagagcaggtgtccaggaaatttcattttccttctcttccctttctgccttttctatctgcctaacacccctcatgctgggaacttctcttctgtccatgttgctattgagactgttaatcacatgttccaaactgaccaatcagaatactcctttgttcctggtttcagtgattggtccagcagtgggcacatgacctgggaaagccaatgagagtctttcggggagggggactcgatataaacgcagggttttctctggtctgtaaggtggtgaaaatccgaagttgagcgcaggcggccggtttgctcacatcaggcctgctaactggggctaatgataataatgatgacagcttggattgacagcacacctgccatgttcctgttgccttacaaccactatctccagcctccctaccgtctagcatgtgccttgctccatacctgccttcctgaggtgcagaggacagcagcgtggagagatggagggacaatgggtgccgatactattgtttcgacacctgcatccggttttgcctgaagtcttttcatttgctggatatcttagttccatgagtcaatattcttctacttctttttaatccagtttattttaggttgttgtgacttccaatcaagaggtcctgactaatatatgattcatctcttttccttctttcttgtttttcttccttcctttctctgccctcccactcccttccttcaccctcttgctcctctctcccctagggtccttgtctctcctagttcctagcctggatcccaattttgtccttgtctttctgtccattcatcatatccgtggagtcctcagataattgtcatactgactcctagacatttacagattataatgcagatctttcaaggctcataggcacacagctctattaggagaaagatgcggtgatgttgacattttggatgagggggtcaaatattgttcagctccagtcagagccacacttcatattgcaggcttctgcctggttcattttcatttttatgcaagcaaaccatcacaagagcccgcctgtgtttaccccctgcccaggtgtattatgaacattgtctctagttcctacctgtggctcacatagctaaggacagcagggcttacctggctggggctgagcgtctcaggtgaaaagtgccacctggaggtggggttgagaatgaactccgcctgatggccatgtctgggtctggcaccccaggagtccactaagcagtcataggcaaaggatgccatttgtctcttgggttcactagtgcagtgggtgacttctgccagcagggagttggtggatattgcagggttggactgtgtttttcagaggagcggcgatgaattagcccatttattttcccatggtctgaaacccaaggaacatctgtctgagccacaagcggcacgttttgtggctggtgggaggacccatgttgcagggtttgattatgcccatcagccggggttgcttggaagcgtcagggagagctggtgattaatcaccaggcacagtggcatggatcccctgtgtaattatccctattgccctcagagccgattatgcttccaaagggtagcggctttcggaaggaggtgagtgcaggctggcccctttgctcacaccagtcctgctaactggggctaatgatgataatgatgacagcttggattgacagcacacctgccatgttcctgttgcgttacatccactatctccagcctccctaccgtctagcatgtgccaccttcaaggtcttggccgtgttcttctaacgctgatactgttatttacttcagttttttctttaaatcaactcaattttttatttaaatgtatttttaaagtggggtacaaaaaattagaaagaatgaataagacctactatttgatagcacaacagggtgactatagttaataataacttaattgtacatttaaaaataactaatcaagtataattggattgtttgcaacacaaaggataaatgcttaggggatgaatatccccattctccatgatgtaattactatgcattgcacacctggatcaaaacatttcatgaaccctataaatatatatacctactatgtacccccaaaaattaaaaattaaataaattaaaaaataaaaaagtaagatttccaactctcttccaagtagaaaactagtaaggctttctaagaatggaaagaaaccatacaaaatatgacataaaacatacaactaaatgctggttggtagtattgcctgtgaggacccagctgagccctgcaccctctttattatgatggggtctttaatagaggtgagtgctgacctgagactttttatgtaaccagagaaatagaagggcagttagaaaaaataaagcacttctcatcatgtctctactggtatacctcaaaaaatcaccaaggtctgtgtctcaggcatcaggggtgttcatgtatttgacttcccatacttctcactcctcaagttgggctctgttacgtccatttcagagttgaagaaacagagccaaaaagaggttgcagagagaggatgttcaagaagggggattccagcccaggctctggagatagaccatcattgttctgtactagatgccatgtgccaagttctgagcttggcacttcaccttcattaccttgttctatccacattcctgccctgtggaactgttatggttttcattttatgggggacacagaggctcagtggggtgcagagatggtcccaagctctcctggcagtaaaacaaaagcagagttcttgaccagggcacggggtgctgcagaggacacacattcccactctcagatgctgcttgttctctccacaaccagctgtggggcagctgctttgccaggggccctgagtgtcggcaacagccagaataacagggaagcagagagggagtttgctggaagggcttgggggaatgcacaaatgtagggcagaagctggagaaatggacctagaaagaaccagagcctaggcactctggtgtccgggaggcctcagggctgtggccagaagacataggcaccttttctactcttttgggggtcttctcctcaaaggtggggaccttgagcaagagggtccagtggatctgctcaggttacgtgcctcccctctgggcagggtgagatccttgtttggagagtcccacccagcaggattcacacaataggaagttgaggcggggggatcagggtgctatcataaagggtaagaaggctaagactaacctccgaacatgcagaagttacccactatatgccagttggccctgtgccagggggccttctatcatactatcctgtagaggtaacaagaagtcccagcctcaaaaaggggctggcaggctgggtcctagttcttctttgccatggctccagcatggacttataccctggattggttgtctcatttcaaagcagggaaagatctctgagagctttgcccagctccctggatgctctgctccaggtgatcttggcaccctcttctgggtctggcacccacacactggcacaccttccatgaccctgaggctcatgcagcctccagactcacctaccagttctcttcctgggattctcagctttctagcataccctcttccagaggtgggagacctccagttaaaaacaaaattgtacacaaccgcagcctcatttccattgtttaagaaattaattatcttggtgtatcttttccaataacagctttcattaaattaaacccaaggcatttatattccctgggaataacaggctgcttatatatggcgggaatgtgctggaatttctttagaaatcagcacattggctattgaggactagctggtgatcacaggtataggttttgaagttagattgtcaggattaaaatccaggctctgccattgctggctgtgtggtcttgagcaagttacattacctctctgtgtctcggcttgcccatctgtgcaatttggacagtaagagttcctatctcccaggcttgtggtaaggattaaacacgttcatgtaatgatcaacaaggttaactatgaacatgctcacaaagacacacatgggctcttctggcgcaatagggacgtggcctggaagctcactgccacgtggcatttgggaccacaagggatcagacctcatcgtctgtgcacagatagacaagatcataaagaggaaaaattagcatcgggaaactggttatttatttaagattgaaagcgggagaaatctgccctggacatcttcccctctcctctgtttgttttgtctgccaaacagaggcagtaccccctctccactctatttattaattgagtaaactccgtgatcctaaatgcaaacaaacatggggccagcacaaacaagcacgtgcttcctgtacgcgccacttctgagtagcagcccgagcaacaggtggactggctgggagacagaaacggctgcagaaggcgcctccaggatttggcgtgagagccctgcaaggtcagcccatgtgctccttctttgttagattgtttgttcattcatttgtttattcattcctttattcaagtgtttagtgagaacttccatgtggaagacaaagacctagctcacaaggggtgcatggtctagggagctaggtgtggacaaagagccacgtaggatgtcagtgctgagatgtggcagccacggggagctatggaagggggcagaaagaagaccccagagctcagggaaggcctgcagggcaagtagggagttgtcagcccagcaaagagccaagagtgtgaggagaaggtctgccagcgcctgaaggggagaagccatggttcaccagcttcaagagttgatacagttgaaagcatcatctctccatggccaacatcctgggctgtggctttaatttgggcatagtgtgtgcctgcaaaacctcggctgtattcaacctagtctgccattgatggagtgagaactgcccccaaattatttacattcaaatttggaagcaactgaaacccaacagtaggagattcattacagtaattccatggaaatggaataatacgctgtcgttaaaagtgttcaaatcttttatggttatgataaatctaataataaaatcgagacaatattagaatatatattttaacattttcctagttttgtgaaaaaagccccaaatatctgtatgagcctagataaatgacaagaaaggaaaacagtaagatttttataatggttattgctcaatggttggatttttaaaaatactcttctataatttctaaattttatgccctgaggatgtattacctccatagtcagaaaaattatgaaaggtatttaaaacccaaactggctttgggcatgcagaatgcttggttatttctgaagtataaaaataactccccctctgtcccatcagcacgcgtgttgcagggagtctgacgttgctcgctaagtctctttggtcgtttcatactaatgccctttgctcccctgattatctctctgaggttggggccgggggatgggggtgtgctaggcctcctggatgtctgtctgctgccaaaacatcctctcctgtctctgtctcattggtgcattttgatgaacctgtattgcctggtcactgcgcgctaaccaccaaattatgaaacatttgtgctgcaagggagctgagagatccttaaactcaatgaaccattaggcataagacacacacacacacatacacacgtgaatacacacaaacacacaaacagcttggctgctctgggtgaagcatgtgtgtgtttgggggaaatttccttccccacccgtggtcgtccatttgcccatgagcagcttccgaggcaggtccgtggaccccaacgctgtgtaacaccgtgtgaaaaacacaaaggcttgcagccctctcactgcagacgtgggaacacgactctgtttaaaacccttcaaagcccgccttcttgccgtgtgatgctgcctgggccagcagggcaggtcaccacgctgtctcttcaaagcagctcgctcatgcccacagcgctgggcacaagggcagccacgagctgtttgatttctgcgtccccagcagatggcttggtgcacaggggcagggctcgtctgtccctctcactgctgcgtcccaggctatgtctccaccatgtaacttcagacaagttcctcagcgtctctgtgtcctggttccctcatttgtaacatcaggatattgataaggatcatagtaatagggatgtccttatggggcctcatgaaaatgaagagttctctgtgatgtgcctggaaccacagagggcagcaagtgggagccacagaaagtcatctctttatcatagttgtcattggtaactatgacggttatcaagggcaggggtctcccaccttctgcatccaggccttgtcattccttataaaattttctcctttcaaggactttcaatgccctgaaaacggaatgctcctccctgctccccatcagctgctgcagagccctgaaccccttgaacttgccttgcttagttctttcaggggctgccttggatgccacctcacttccctcttcttggctctgtggctgtcagaggggctgggcactgggttacttcatcagttcctgggtgttgatcggcaggaaacagtggtttcctgttcatatcctgcctgagcctgggccgggtggaggtgtcctgcatggagtcttgtgaaatcgcgtggactgcaacacccagcagcgcggtgagtccaccctgaaatccacagtgacccacgcggcatgtgctgggaattgaacgcttggggaaagagctgggctccagcggatcagccccgaccaagtcgttcccacagctcaggaccggacgctacaagcccactttgtagcagtttggcggacggcaaacttttgcaacacagtgcaaaaaccatttaacacctttaagggaattggaaatgggtttttcatgtgtggtggtgctgaaaattgagaataatgacagaattattaaaaacagccttctcggccttagactcttaattgcctctggtctgtaaaactgacaaataagcactgtagaagccacagatgaaatatgtcgtcttgggagccctggagaattgtctctgaattcttttgtttatggattgtagaaactgctttgggggtagttggatgtagaagcagaaggacagagtggggagctgggagcaggaggcctgggtttgtctcctgagtctgtttccactggggcctgaggctcccgtgtgagggaacatgaatgggccaggcacatgggccctgtggggtgacagagctgtgggctccatggtggctctgtgggcagctagcttggggatggctgagataaagacaagtagttttccttcctgcaggacttctcagagcctttagtgtggttataatgatagaaaacagtattaagtccataccctgaaccagaaacaatgctaaaagctttgcacttggcctttttttttctttttcttttatcaacatgtgtgaggacggaagcttaggcttacagatatggactcattgagagtgagtggacgtgtctgatctttaacccagttctgtctgaccaaaaagcctgtgctctaaccactgtgcacccctgcctgtctgtcctgttgagagaactgtagggaaagccttgagattatgtatccagtgctcccctcctcctgattggaagatggcagctcagaaggttagggtgccttctcctgtcctccgagtggttagatgcacgtgtcctcttctgtcctctgctcttcccacatccctctctctctggtgctctggtggagcccctgggatcaggggtcacaggagcacctgggccatttgcatggttgttggtaaagggtgttcccccaccccccattaaggtgcctgccatcaaagtgccttattgcttgagttccaatctcggcttcacaactctgtagctgtgtgactttgcacaatgtactgagcctctctgtgcctgaacatccttgtttgtagatagtaaagataattgtcccttactcctaggtttcacattgagtgtttagcaagttaacgtttgtaacgtgtgaagtcataagatgcaggactggatgactgccctacccacaagaggcctaggatcttcccaagttgcactacttatgggacaggtctgccaagcagcccttgtgaagataaaggtggtgatgagttcctcccacaaaacaagagcctcagagagactggaaaataacccccggtgccttttatcaactggccagcagatggcagaagcaagccaggaacagagcttgtgtgcggcggctgtggcagctacctttgaaaatcccgtggtgtttggtggtcgtattaagagatctctggtgtaggagcatccttcattctaagcaggattctgaacaaactcagaactggctttgtggctggtaccgaggacccaggggtcacggctgctcccagtgggtgctgatgcccatttgtttgtgcaagttggtcccctgtagggaggacagatggtctgtctcggactttctggcctgtgcaccaaggcccagggatggaagtggggcagcatgtccccatcattaaatagggcgttcttgataataatcccataaggcctaatgtgatgggtgtggtcaatcattcattcattctgtgaggattcagtgagcagctactccatgcctctaggctctgaggacgcagcatgagaaacacacggaaggcccacgatgaccagggagctcgccttccagggagagaggagaaaaataaatggtagggagttaaacacgacaaagtagaaaagggccagctgcaagaatgaaattaaataggaggctggtggcaggggggcagggaagcctgaagcacctgactgcccagaacaagccgcacctgtgaggagctgggaagggcactccaggcagagggagcaccagagcaaaccctgggagggggatgagcctcttgttgaagaactagaaggaggccaatgtggctgagcagaacacatgaggcggaaggaggaagtgaggggccctgggcctggccaccaaccggcagatcaggggtgaggactccacttgggagagtgtgaatggcccagtgtgaatgacaaagcagtttcatgcagctcagcctgtctggctaagtgcgcagccctgaggattgggctctgagcgttgcagcccttctgagtctgtgggcccctctcccaggaggatcaggttgcccagggcagctggaaatgtccttaagtgactccttgctgctgctgccgctgcgtcttgctgacatcatttccccgcaacaagcgctggtctcctggggcggctgccccctctcatctgcacatctagctcccctgccaggcctgtgctgttttccggggcctcacagagaagctcaggcaggtggagcctcagcaacaggcgccatcctccccttcagcctgtcgcggctcctccctggggcatgcttgaaagcccagacatgttcttcacatctgagaaagcagttaaactgaaattcctggcagactcaggttcaaatccttattaggctgttaagtgagaggggatttcatttccttgcagccgccctgggtcctgccactgagcagctgttggtaggctctgctgtgaggtctcctcttccggctttcccacttcccaaggtaacctggtgtggggaggaagccgggggcctctggtgaatgggaacctgtgcaaagaaggagccgagggcagggagaggtgggataagacccagcgtgggggcctgaaagtgaggccagcagagagtcattgagaggccctcggagaatacgttctggggacgcagtcagggaacacctgtttcctgctgtgtgactctcacaacccagctgtggacacacacgtatgtacatatatgcacacacaggaacacatatgcacacacaggaacacatgcacacatggacacacatatacacacgatgaatacacatacagacacacattcatatatacacacatacctatgtatacacatgtacacacatacactcacatgcacatgcacatatagacctacagatacataaatgtacatccttatagatgcgtacatatacagtacacatgcatgtactcacaaatacttatgcccacatctacatatatgtataatacatatatacacatatagatatatacatatatactcacatgtctatgtataaacacacacctatatgcacatgcctatacatatatgcacatacatgcccacatacacctatgtaaacatatacacacatctatatttaaatatgctcatgcatgcatatatacacacatatatacacatttatgcatgtgcattcatgtacatatacacacatgcactgacatcgacacatgcatgacacaatgatatagatatacacacatatatacatgcatgaacacatctatatgcatacatacacatatgtggatatagaaaaatagcagatatacacatacatgcacatatctgtatgcacacatatatacatacagataaacacatgtacattcatctagatttccacatttacaagtgcatattggtacacatatgcatacatatgtgtatgtatgaatcttttctccctctatatcacacacataccttttgctgagggcttagtatttactaggtgccagactctgctctcttaatataaggtcgccccaaaacagaccctgagctgaggattcgggtgcaagcggctaacatggacggtgatccagcagcaccgtgaggaagtggggctgaaacctggaagggagcaaggccggggattagggtgaccacagacaaggccatcactgaggaccttggggttcaatttctccagtgggggtgtctaagccactatgttgcgtcacgtgtcagaattgccctctggaggactggaaaactgggtgttgactgccacttcctgctcctggccatgaactcctggtgcttctagtttgcccagcataggccatgtgctcctggggccagcgagggtccacaggcagaggctggggacctgtgctgcaggtgatcgcaggtgggccctgggccaccacacgctccacacaggtgctgcctcatgggtctttcacaacaacccccgtttgacaaggaagaatctggggcttggggaggtctatagatttgaggggtgttatgggcgaggctcatagcagaaccaggtcaagaatcaaggttgtgtgattctagcaggtaagtcctgacaatgactggcaagtgtgagccatgcaggggcaggacaggcctcatgagtggtgacaggaggtggttcagggttgttttgcacagccaggcattctttgaagggcagctgcagtgaagggcctggctgcacagccagcctgcctgggtccagatcccagactcaccatgtcctgagggagcttgggggaactgcctgttccctctgggcttagtttctcgtcaacactaagaagactcagttgagtcatgttcatgatggagtgcttgcaacaccaccagagaggaagggattgtgaatgaggccgtcctggggaagcgcaggtgtgttggggtgggcgggtaaccaggtattgcgacaggggcacaaggtggcactcagcctccttgtgtttgtagcagacttttgaacactagactttctggtggcacctgtagcacccttaaaaagtgaatgctgctgcccaaattaaatctgagcagactgaactgaacgtcccagcataacctcaacgtctctggggccccatctgccctgctcttagcatcccactaagagaagcagcagacactcaaagcaattggaaaaatgacctgagttcatccaaaccctttaaggagaaacctctctatgactttccctacgattctttcaccccgtatttctcccctcccatggtctcactccagagcttttccagagcccttttctttcccagaggctccttggagccagccctcacggctctggccttgttttctgctccacgttttagcatgaggcaggcatgctatacggcaaacatgacattttctttattgggtaggggaagaggagggctgaacctctagcgcccgaatgcatttgtccctgtcacacacagtcattgtccaattaccttttgggagggaaaacccagtactgatcactccgcctactccagtttttcctgatctgaatgatctgccttaacaatgtgttaacattttacccaagttcactcagaataagaaagtgcgtagaggtgcccactagagggtgggcgcacagcagtgggcatctcggctctctgcccgtggggatcctgccaggttgttcagagcagctcctcagtgtcactctcctccccaccctccctttccttggggtctagccgtttctagctcgtgttgcccctcccaagctggatgtaacctagcttctgtcttttacctgttacctcatttgtgcagttaacattttatgcacgtcccttacagtgtagaaggaaaacataattctaatctgactccattcagtgatgttaaatactgcatgtgaacatccccatccagaagttcatccaatgtagactcatcaaaaagcaggagtcctaaatgtttgcattgtgcaagcatccttagcacattgctatataggtgtttaagagtgtcttaagagatatttggaaaattggttggggattgtttttgttggcctgggaatgtattattattttttcccagttcacataaaggggtgaagccctgatgtctggaaatttgctctccaaagtgtttccaggaattgacaatatttggataatgaggggtgtctgtactttccttgacctaaactgctggtagagggggatatttttgtatgattgggcaaggtcaaacacagaatcaaatcaggaagaacagggtctgacatgatgaatccctgcctcgccttgccattgacaagagacagaataaatgcccccaaagaaccctgcaccatgaacgcttgatggcaatcctgtctcagggctttgctgctcgctgtcaggcagcaggtacactacccagggccgtggggaaggcgtcttgcagccacactgcagcaggaggctggtcatatctacgggctccaccaagccaggatgcagagctcggcccgtctcatggcacaggctcgggctgctcggagcttataatgaattagagccacagctgattattttcaaggctggcgctcacgctgggtgcctgagaagacgatgaatctgcagtgccgaagtgctgcctggcctctcaggaaccagctgcagctgggattctctgcagccttccccgcagcaagctggggtagccatgagccctgcctgtccaacgtggggtcaggcgggcatgcctgctgtgtctggcagccttgacacccccagattctgctggaagatgctcgtggcctgaaagctcattttgtagtcgctctaccctgggatgcagcttctgcactggcaggattaacgcaaacagaatctgcttggctcattcctcgccgggcctcaacaggcctgcaacgccactgtctgccagggagagccactcggtgatactgttaattaaaaccatgactctgggggcaagaaaaaattttaaaacgctgaagtcatcttccctaatagaaatcttattttgaaggtgctcacggaggtcaggctgaccagaaaaacccacaagccataaataagctcaaatagttttatttaatttacttaactcggtgcctggagtcctcatggggagaggtgcctggcatcaacacagggtgggggtggccaccctcatctctagcccctgggtcccagagctgagaggagggagagaactgaactttcttggaagaatgtggaactgctgagtagatgctttggaatttgctgacccaggcatctgggagtacagcctgaccggccatctctgcgccaagctatctatagtccaatggctattttcaattggaaattcattttaaagtggtggcagtgacgggggagtggctgtatctgtaatccattatttcacacagagaattcccttctttcatttttttctggccaaagttgctgctttgaacgtgggtgggtcttggagcccaagactgagctggctgcttggagaaaaattggagggatttgaaaaggcccgagggagggtgtcctctgagttgggggtggcagaaaacatcttaaatgtgcaggcccaagccttctgcagtgaagggaataggactctggcttcggcagacctaactcagtctctgggttcttgggctaatttgtgaaattacctctcccctcaggactgggagagaacggccttaaataagtgcaatttaattcccttgattgtggtcctctttaatgaaaaaccaaaatttattctctctcctgctagtttcccattgaaagtcacaagaaatgaggctggggtggagggcctggagttgctatggaagcatgatgcctagaacccactatgggatggatggtcattggtgtcacggactgtggtgtagacattgtctcctgtgccaggatgtggcctggtcctgcacccctttgcctttgaagctgtgcctgcctgtgatctgggagtggcacgaacccacagaacccagcccaccctgcaggaagtgggagagctccccgggtactctggtgctgaggaagcacagcttaaagaggaaatttccttgaaatccacacagacctccttccagaatgttctggaaggaagcacaacttcaagaggaaatttccctgaaatgcacacagacctccttccagaatattctggaaggaagcacaacttaaagaggaaatttccctgaaatgcacacagacctctttccagaatgttctggaaggaagcacaagttaaagaggaaatttccctgaaatgcacacagatcttcttccagaatgttctctaaatcctcctccaattcaactgtcatcaccacagaacccacaccctatgataaatggccagagcccttactgtctttgttttactccaggcgtctcaggccactaacaaggaggtggaggtctcaaggctattgtcaactgattctgctggaggccagaccaaaatggctttcttccgtgacagcgtcagtccagttacaaatctcccggttccatgataaaggatttggctgggctatggccctggtttcttggaggaaacctctaaatccttgaaacttcccgagtgataggagaatctatgttattcatggtgggcctttccaaccatacctgagtttatgcttatgaaattaccaggatggaagctgaccacaccagaaaggtcagccaggtaattggaggcttggggctttgaccaacatgacgtcagtccttcagtgagtggaggagggctggagattgagtttaattgcatggccagtgagttaatcaatcatgcctatgtaacgaaactccaataaaaattctggacatgggctcaggtgagctcccaattagtgaacacatcaaggtgcctacaggtgatatgtcctgatccacagggtgatgccatggaaccttccaggcctggccctatgcatctcttcactgggctgggctgtatttccaccatttgataataacactgtaatcttatcactgcagcagtttcctgagttctgccagtcgttctggcaaattatgaaacctgagggggttgtgggaaatgccaaatttttggccagttggtcagaagtgccagttctggggagcctggagctcctagctggaaattcttgtggacagtgtacctggcctctgatgtctgagccagttctgggtgttgtgtgttgggatggcactgcagtccctaaagcaagttctggggaatggtaggaaagcatccctgcatctatatttccatttggtcccggtctaaagcagctggtcctcagaattgtctagggggcttttagaaagaagagccttctggaacccttcctgaacgattctgatcccatagtcccgcaatgggccctggagtctgtatttttgaaaagctttcctaagtagtactgaggcagaatcatatttgagactaactttccagtgcagccaggcatacctcccaaaaagagaaaatctgtttgaaagaagggaaaatgcagaaaactggggaggccattccccagtgttctaacaagtcagggaacaaagggacggcagatagaaagttccatgccgggaggtcagtgctgcagcctgcgtccttacgctgaggtcagtctacgaaaaggcatatttggtgaccctgcatccctttctgggtgttaagctctggagacacttgcgaggccttcttccttctccatatgtccccccttggacctttcagatgtccttatggtcctgacatcagtatcctatgatgggatgcacatgctcgacctcggggaccagctggaagccctagctgctgctggcaggggccaggaccctcagcactgagggtctgggtagatggaactgcacaccttgcatctggggcgaggaagcatgtcctaagaactgagtggcgcacgaggaattcacgtgacagtttctcaagctggtggccttctccctgtctcctaaaactgccctgagctgcctctgtctcccaccggggtgacagccacatctcctctctgatctccctgcttctcatcttgcccctatgcagcctgttctccacacagggcgatcctttaacaagtcaaccatccatgtctttcccttgcttaaaatcctccgaggctcctttgcactgtgaaaattagagcaagagccctggggatctgtccttgcctgtttcctccccctcacttggtcctgtcatgcatcaaatcatagccacatggtttttgctttctgtttttcaaagaatttcaaattctcttctcccacagggcctttgcacaagcttttcccacagcctgcaacacctgcccttcttccccacacttggcttgttcccagaaattcatcatcctgtcttaaatgtcacactcttcagagaggccttctttagcccagatacataggtaggttgaccctattgttgtctgtgacattatcttcttgatgtctttggacttaatcacacttttaaatatatatttgtttttcctgtctcttccacgaggctgttgaatgctgcatggacctgtgcccggcacagagaatgtgctggtttcagtagagtaattaatacaagcagcagcagtgaataacccagacaacgtcagtggcttatcttggaaaggttttttttttttgagacagagtctcgctcttgtcgcccagtctggagtgcaatggtgcaatcccggggctcactacaacctccgccttctgggttccagtgattcttctgcctcagcttcctgagtagctgggactacagatgtgtgccaccaggacctgctaatttttgtatttttggtagagacggcgtttcaccatgttggccaggctggtctcaaactcctaacctcaggtgatccccccacctcggtctcccaaagtgctgggattacaggtgtgagccactgcgcccagccaaaaaggtttatttcttgatcacatgactcagccagagcaggtgggcatggacctctgctctccccactccacctaaagaaccttctccacctcctggtctccttacctggaatatgtggcctatgaggtttgccaaagaggagaaaatggagacacactagctgttatcagcctggcagccacaggctcacttctgttcttggcccatttgcctgaccagtcctgtggctcccaccacctgcaggagagtggggaacagaggaggcaggaaagacactaggaagagtggggagggaggagaactgcacagctggagagggtaggagggatgctgagtgggtgctgctgggaggagggtatgtactactgggaggagggacgctgggtgggcactgccaggaggagggatgctgggtgggcatttctgggaggagggggggagggggaagagccacacagcccgaggtccgtggcaggaggagatgacaagcagggagaacaccaacggaataaactctgcagtttccttcagatcatccctgcataggtgtttctcgaaactcatgttcagtgagaacagcaggcatagactcaggacaaaccctccatctcctttcaggttaggttggcccatgggctggagcgtctgcgtcttggtcggcccggcagtgtacatgtcaagcagcgcgcaaagactccacagccattcgtaggcactgctggcctcatgctccagacagccctgggacaatgggccaccaagggaaatcaatgattgcgtgggcgcaggtgacctccagcctgcttcagggccacccttgttccccatgccaactccctccttcctatgggctcccaagaaatgggtggcagagaccagcctggtgatttacctcctgcctttccgtgacttcctcccagtcctgtgcatctcatgtttaattatgaggctgtggaaggtggtgatattaattatagggctgaggttgtgttacttggagaaagtcagtgcacatgtcatttgattttcctcaagaaggaaaactgtattttttccgatctcaaaaataattccagggaaataaatgtgtacaatcacactttggggtttaaaactaacgagtttcagttttaaaacatgttaaaaacctttctatttggagaaagctggaagaatccactttggggatctggcggttctcaggagctgtattacctcgggatggtctcactggttggtagcagcttttgtatgaggaggggcatggggtcccgacttaggcagagaaggctttgctgaagaggtgcaaagcccagcttagggctgggttttctacagaccaggaacaaaagcattgcttggcaagatttcttctctgctcagagaaaacacgcagattccaaagagtgagatggagagaatttgacatgtcttggtttgaaaataagtcaaaagaagtctaatattaacaatagcaataataataacaaccattaattgtgcctgcgttaggtaccaggccctattctaagtgttgtgagtgccctctgtcatttaatctccacggagtcctgaaggtgcttcccaggtttgtccccatcacacagatgaggcaatcgttctgttaagactgtccttgggtcattatgtcagcaatgaaatcggtgctgccattactaaacccttactgtgtgctggcatttgtgtatgcatgcatgtgtgtgtgtgcacacgtgtgtgtttgcgtgtacatgtgcatgtgtgtgttgtgtgcctgtgtgtgcacatgtagaaagaaagtgatgtgtgggaatggagaattccaacccaggaggagactgtgcctggggctgccatgagaagtggtgacacttcgagaaacgggttccaaatgcacgttgccttccagttctctgtgtgaccttgggcaagtcacttcagctccctgagctttgtttttaaaaatattttttaaatgtataaaaccatggaccattacatatgaagagaaatgtgtgtgcaaacattcagttaataatcacaaggtggaggagtgcctgctcagacccagagctgacacagggaactctcccagaaggctgcagggcttccctcccaaccctccaacggcccagttgctgagcccgtgcttatctgttcagtggaaatgccatgtgccacgttcctcagaagtaaagccactaggtaagtgtgacactctgtgcccagcttggtgcaaagcctcttgtgtgtgctatcttattgacctcccaaatagcatggtaaggtcagtactgtcacttcccccactttgaagatgaggagagcacaaattctagatggaaatggaggtcacgcagtggaaataggatccagacagattaatccaatctcaagcctgaattcttccattccacgctacgcttgaagctcaatctctcttcctggttgattctccccacttccccacccccagatatatcccatcgctgcttggtggacagtagccatgactgggttttggtaaaggttgctgaataatcaggctgctggttagtttttacatttcacctttcccagtgaaatggggccccatgaaaaaggcagctcaagttgtaaattactcaaaggaaggacagaaaggtcttctgtttgcacctaccctaaggatttggggtagacactgggaatttactaattatgaattccagtgctttccttgctgaaagagaggcgtggaatcaacgctgagtgaaggcatcaagtttaagctgctaattacttcctgatcatgcagaataaaagctacgtcccttgaaatacaccaggcagctaaacataatctttgcgtttccgtagtgttggttaaggaatccagatgttactgcaataaccactccataaacaaaaggaacacccagctgtgagaactggcttctcagcattcgtcccagcagaggctcttctggggccagccctggaagaacccatcagggttctgatggttgccctgtttcagcacagcccttattggcaggcagacggctacgggcacagccacaggctgaaggtgagtccagcacacaactttctgacagtgaacaggagtaaacatgggacccacccgaaacctttgtctgttgacttcttagcaaatggaggcagctctaggctctggagagttcgggtataggagaccatgacttgagcagactgatataagtggaatgcaaacatatttagatggcacaacttaatttagatttatcagtgctaatatagaaaaagctagtatttattggggcttattagatttttagtctgaatcctcacaacttacgagggggttcgttttacagactatgatcttgcatgatttccccaaagatgctcattaagtatatggtgaaagtagaatttgaatacagaagacctggttctgctactttctgtgtttctatttggttcaaaccagcctttcttctttcaaaacaacttcagtgcaattcatggttttggaaaataaacttgattttgagattcagacaataagtgcatttttaatgtttattcttttatcttgaaaaactgatatatttatgaaatgatatgtgctcactcagtgtcaacacttcaaacaacacagacagtacaatgacaaattggagatcagctctaatctcggcccccaatttaatgcattgctgaatattcttctgaacatagtccatcccacactgtcccatgacacaagacgctccaaggggctgaagatagagggacttctgcagtcaagagagctgggaaactcttggacagtcacaatgtgcatttgggtattaaaggctctgcaaagttctgcaccaaataaacccttggattggcttgatccaatgccatgtttccaaaacctacttgcccgtgggacaccttagtccataacacaggttggcatttcttctagagagtgtgctgtgaaaaacactggtctcacagcaccgtgcattcatccagcaggtatttaccaagcagggactttgggccaggtccgtgctaggctctgcaggtggaccagccagccctgacctccatggtgtctcttctcatgggagaggctgcacagcagtcattgagaaaacgaagaaacacacaggtactttcagatgctgataatgactaccatgtgctaaaagagctccaggtgttgtctgttttgagacaatcttctcgacaatgagatagaatgaaccatgcaaactttgggggctacgatggttttaggaaagagctagagtgaaaaatcctttgacatatatacatacaaataaagatacatgtgtataattttatgtaattgacatcacattatatgctggcacctgccttttttgcttaatgaaaatgtcaaaggtaatattaccaatcaatcaatatatttcaccatcgtgtttaatttctgcagagcacttattcaagcacatactgcatttttcttagtcactcactggtgggaatagaaagttttctcaggcatgcatttttcccacttctgaaatgatctccttagaataaattccccaaattgtattgctgggttcaaaggcatgaacattttacatttttatacaataatgtcaaactaccttccggaaatgatgctcactttactttccctccaagactgtgtgaaaatgcccattttcctaaatgcttactatgactggtttccaactacattttaattcttgttcaatctgataggcaaaaaatgatatttaatttttatttgattgataatgaccttgaacgtgcccattagccttttgcatgtattcttttatgaaacatctgttcctatccttcgtcaatgttcctcttcatatgttaacttttcttattgatttgttagagcactttgtatattgtgaatattagcttttgtgatcagaattatggaattgttgttgtctttagttttgcttatcaagtttaaagccattcagagatgttgtaaatgtgtatgttgttaaatttatgtcttattttgtgttttctgatgctcatatgtttagaatggtcaagcaatcccaacttatgattacataaatattctcccatatttgctcttagcattttttttcttttcatgtaaccctttgttctttcaggaatttactttgcggtaagaaatgggctggcttccagttttatgtttcccaaatggtgattcagctgttccatttccatattctcccttattagaaatgaccactatattatgttctaaaatatctgcgtacttgtgtcccttcctataatctcagttcatctctttgagctatcttttgattcctttttcaaaccacactgctttactgaactgtcatcatcttatacatttttaatactcagcaagacaagtttctcaatgccactctttttcagagtttttctggtggttgtaagatgtttattcttctggataaactttagaatcactctttttgtccaaggtaaaatatatcccacattgagatcatactgaatatacagactaattcaggaaaaaatgtatgtctttattgcattgagtcttcttatccaataaaaaagatatgaatttccatgtattgaaatcttcactgagacttatttttggcttttcacatgtcctgcaaatgtattgttaaatttatttttaggtattttaggggaaatgattttctaaagtttgtattttctagcttgttataatttacatatgagatagtcattgttgtatattatttataactgatcatattactgtatttgtattgttttaatagtttttctattattttgggttttcctggaatacaaccttattatctacaaattatgattgttttgccttttccaatgttcataactgtttttatattcttgtctgattgctttgttcagcacttctagaataaagtcatgcaatactaatgataaagggtactctgaacttgtgactctcataggatgcggacagtatttttacaagaaaatttgatgataatttttggattggaatgtgcattaaaaaaattctacggtgctcacacctgcaatcccagcaccttgggaagacaaggtgggtggatcgcttgagcccaggagtttgagaccagcctgggtaacataccaaaatcctgtctctacaaaaaacaaacaaacaaaacccaaacgacaacaaaaaaacccaacaattagccaggcatggtggcacacacctgtagtcgcagctactcaggaggctgaggtgggaagatcacttgagccctggaggtggaggttgcagtgagctgagatggcatggcgccacagcactttagtctgagcgactgagtgagagcctgtctctaaaaaaaaaaaaaaaaatcaaaaaccaaccaaacgaacaaaatcttataagaaggagttattgataatttcaagtatcagaaatggatgttaaatcttatcaaatgtctttatgacttataagaaatgatcatatacttctttatcctttgtcctattaacacgttgagagtattttttaaagtttcccaaaccatatagctcctggattttgcaaatgagttccgcatcatcatggtgtgttatttaccagcgcttttctcaagctttttgggtgaactttctctaattaccttttctgcggggagtctgtgtcaggccctggcattcaggttatgctgactgtggagaaaccattcagtgactttttgtctttctcaatgtactggaattgtttccatagtacagaaataatcagttccttgaagatttgagaaaataagactctggcaagcagtaacttctatcccactgttgggaatataaatggtttcagccactttggaaagtcttttgttaatatctagttaagtcaaaacacttgtaccctatgcttccgcaactctactcctctatctgggccctagagtcacggtccccagcgtttttggcatcagggacgggttatgtggaagccagtttttccagggactgggttgggtgggggatggtttcaggatgattcaaacaccttacatgtactgtgccctttatttctattattattagcacaatacatttattgtgcactttatttctattattatattgtaatatacaatgaaataattatacaactcaccataatgtagaatcagtgggagccctgagcttgttttcctgcaactagctggccccatttgggggtgatgggagacagtgacagatcattagtctttagattctcataaggagcacataatctagatccctcgcatgtgcacttcacagtagggatcacgctcctatgagaatctagtgctgctgctgatcagacaaaagacagagctcaggaggtcatgcaaatgatggggagcagctgtaaatacaggttaagctttgctcactcgttggccgctcatctgctgctgtacagcccagttcctaactggttcctaacctgtaccggttcacggcacggggttgggggccctaccctagagaaactctcttatgcatgcccaagaaatcgtatgtgtcagaattttcattgcagtgttgttcgtgctggttaacaaatcagaaatgacttaaatgttccttagtagcggattggattaggtaatttatgtagtggattactctgccacagatgaaatgattaaattaggtctactgatatcgacctgggaaattctcaaaaaattagtatgggggaggagacagtgagaagaaagtgaaaaagaacatgttcatcatgatacaatttgtgtaaaaataacaggaaacaatgttacatataattttgttatataacaaataacaggaaataatgttatatataattttgttatataacaaataacaggaaacaatgttatatattattttgtgcaccaagtgtggataatatatacacatatatcatcaaaagcacagaagagaggggtattaatcaccttcaagaatcagggtttcccctgtggagggagggagcggagacaaaatggtaacagagaagtggagcttcaaaggtcttgtagtatttcatgcattaaccaaaaaaggtctgttgtaaatacagaaacacatgatatctttgaaagctgtgtggtggggcatggatatttgttatattaaccacacttcatttatggtctttatgaatttctatctggtttctccattaaggattagagaggtatttcaaaggctcctattgtatttctaccaattctgtctgttcatcttccttttaaaaattggagatggaggctggacactgacaattgttattctttagatactttgagttagataacacagtgcttggcacggggcaggtgtccaataagcgctaggtggcatcatcatcctcttggacactttggctctgtgtgcatccctccaaatcctctgttcccttgccttggtgtgaagccagtgcgcttcaggtgaacccccgtggctcccagctcttcccaggctgaggtgggcatggcgccccatcgagaagttggagcataggcccttgtgcttggtgagaacattatgtgtgtccctttttgactcctttgacttgcaacactgattcctaggttacacttcgggactgcctgccagttcgtgaaaatgacagggctgtcccttctcacctgggtcctgctgttcacctgacctgctggggtggggcaccagcccaggcagacagtttctctttcttcctggtaacctgtggtccaggccccactctcacatcttctcttacttgtccatgagctaaagtgactcacctcctttgcacctttcactttgacctgatttggattgcttctggtggatttccatcagtgtggcatggcggtgtgctttccccagtttcagggaaggctgacttaactagtctacttgtggatcctttgggtccatggatcttactttggggtgattttgcatgatggggatatttggcaatgtctagacacattttggtcatcacagctgggcagggacagagggagggtgtgctaccagcatctagtggtggagaccagggatgctgctgaatgttttaagatgcacaggacaggccacccccctttaaacaaagatttatccttgaagtataaatagtgcccaggctgagaaactctgccttaggcccaatgagccaattttactctggtatgcctcactttgcttcaacagctgggcttcggagagacagcatgcattttacattgatgtggtctgatgtaacaagcaccaggcaccttagtatcataatatgactgattagattatcatttgcattgtcattttgttaatgtgtagaggaggaaatattactggaagtcagaagatggatctttgttatgccaccttcttccattcatgcatgcgtttaacaactatttacggagcatctactatgtgctggatatcatgccagatgatgcccttttagtgctctcagtccagcaggaacacaggggaaaaaacccaaccaaatacacagataactgtatgtcttggagatggtagcgtgtagcagaaaggaaataagagcatcagggaatccacccatgtaggcggtgtcttagcctcctgtggctgctgtaacaaacgccgcacattcaatggctccaatcactagaatcatattctctccaggtgttggtagggccttgctatttctgggggctttagggtaggatccttccttgcctcttctggttttcggtggcatctcctggccttcctccctgtgtagctgcatcactcccatctctgtctctgccgtcatgtagacttctgtgtctgcatcttcttctctcctgtctcttgtaagggcacgtgtcattgatttagggcccactctaatccagaatgatctcatctcaagatctgtaattacatcggcaaagaccaggcccttctttccaagtaaggttacagtcacagattctggggattaggatgtggatatatcttttgagtgacacttttcaaaccactacagatcagcaaaatgttccctggaagcccctagctgatttcttttctgttttttttttttttttttttctctttaatcaccaaaaggagataaatggattaggccaagcgagattcatccacttttcctaagcacattgttgctcaaacatagatttctaagaatcaagaagaaggcagggagccagcagggtctgccccagaagctctccctgattttcagatatgccaaactccatcttctctgtaggtttttttctttttgcttaaaacagcagttctgaagcttgggaaggcatcagcatcacctgggagccttgctaaaacgctctctcctggagtttctgctcacaatgtgcatttctaaaaagctcccaggtaaggctgatgctgccagtccaggggccacactcagagaaccactgctctgaaacattcttcctgctcctggctcttgtcactcttgtcttcccccttgaggctcccttttgcccagagcttcctggtgtctccaacccatgggtttcaccctttccttctcttctgtggcatttaccacagaaatcttcccttcagctccacacagggcacatgtcttgcaggcacagatgttgtctttctgtctccattttcccagcacccagcgcctcgagtccacagggacggcaatgctgagcgtctgttggatgaacaagtgaacgagattcatgcacgttcttttccttctctgcagagtgcctgagcctgccaggtcttatgctgtggtgggctctggactggagactgggttcaattagtgcctcagcaatgtgactctggttaagccacttaaattccccgagcctcagtttccccatctgtaaagtgggcataatagcacttaccctaatctcaagggtatcaaatgtgataaaaccatataaagtgttcattgcatttattaagtggctgatctgtgttaattactgttagtatcatttaaggctggaggagtgcaccttagttttctcttgttgggacaaggccagttggttgtgtgtgccccttggtttaaccctagggcagaacttctttggtttggggtgcaggcctcaggggtgcagggctgagaggcagaggctgagtcaagcccagggagaaggctggtgtgttgccctggagcaccagtttcctccacagtcagcaatgtcagcctttgaagactattaagacaaatgcagttacattacagaaagcaataaaaatgcttgtgaatttttaaggtaagatacctagattttagccaggtcctgggctggggccccctccttgcagacgttcccttcctttgctgcctctcccatggcccctgcacaaggctgcaggatgggtggggctcaggccttgcagcagtgaatggattgatgaagctgcccttcaaggcacttctcttttccttacacaaatgcttttgcaactcctgtgccctgaggctctgtcttaaactggtgtaggccccagtggcagggctgacacctgacagctaagcctgggaggaaatgcttttgattgttccatgccagaatactccaaccttcacctccctggccttttgtgctggaacaaggccaatcagttctgtctgctccttccagtggtgatttggtttaatcaaacaattgcatgtctgggagagttccctgtccgccttgattatacatgcatcacccttgccccgccttgcacatactccccaagtcacattcatccaatttcatttcattgcagataaaccacacacagaaatagacaatgcaatcaccacagcccgtgtctagaagaacatcttgtccaagcgcaggtgcaattttgcctccacttggccgtgtccttgctaccacctgtgtggtcttgggccctgcgtgggggagcaagagggcctggcctccttcctgtctcatctcactgttcttccacacacagcaggtagcgccctcccagccaccctccccatcaccgtcctctgatttgtgaggtgcctgacagggagccagggaagggctcactccgcaagcacagtctcccaaagtggcagcgtctcagcactttgcagagctggcatgatcgtttccgaaatgtccacccaggctctagggcagggtttcttagcctcggcgctattgacattttgtgcaggatgcttctgtgtcatggggctgtgctgtgcacggtaccccggcctctacccactcgatgccagtagcactccctctccagatatgataaccagaagcatctcttgacaaggctaaatgttccctggaagtcaaaatcgctgccagtggagacccattgagagacaggaaggtgcagacaaggcgtgactgaagagcaggtggtcagcccctgagaggccttgatggagcctatcaaagaccctgctcacctgacccctgacccctccgtgtgagctctgcccaggccttgctctcagccttggggtgctctgcatgcagaacccctcccgcctgcacctctgaggtggctcttcctctgcagggttgcttttggcacaggtggaggctctgactatggggacagggctccccctctgtcatgctcagcgctgtcccgtctaagtctcatcgctcatcaggaacacccaggcccttggctccctttaaagctggtgttgggcctcaatgaatgcctctctcttttggctggaagctccaatattattttcctctttttattggattatctttcttgaggtattcaaatgataagacaaaaaatatgtcaaagcctaggctgtcagctgcagggactggcagtcctccattcaggaggctgagcaggtgagggcttttgattaggaagctatcatgctctgattttttccagaatgatcacttatagatcaagtgaactaatctgtcccaatttgctcatcatgactttaggtctttatctgcatgtctaggctatccctgttcgatttacaaaaccaagaacaagaaaggttgaccttacagcccctatgaggccttgacccagacggccgcctataaaaacggcccactcattatgcggtcacccaaatggctcaaaggtataattggcacatttgactgcatattactcggccctttaaatatctcttctgatgtgttaaaattagcttcttcccaaccacaaaaagggaaaggagtgtcctttttaagcaaatatggggaaaaagctcctctttgtctggcttagttaaaaatgaccccatctaaagtcaagggtatgtactgggtgacctttcaaggcagcacccagacttaagatgtaagaattctcctttttcgattgaaaaaaatagactttcttgacacttcagagccatcatagcacaatgggaaccggagagagggaaggggcggaagggcagagaccccagctgtacaatgcccctgggtctaggcttgagcgaaggtgtgggagtgggagggagaccatgtggctcacggtgcacagaaaggatttgatgtaactcagccctcctctgtcccccaggtgagtatcgtgtgtgctggcttctgtggataggggtacagcacacagggagtctcacctgggtcttcaatatgcttcatctccatttcactgcagacagacccaacctcaacctcaggggttaaacagttgccctgggtcccccagggtgcaacggaaagagcaggaattggaacccaagtctgtctgacccaagggccaagctcgttacagttttctggtactgaggttaagggaaaaatcaatcttgcttgattttcttccctgaccaaataaaagcccccaaagacctagagaattcatctgaggttataaaaataaagtaaaagacagccctttgggaacagtcctggtcttgaacttgagctggtgttattgctggtggaggtgcccacagttttcacttgtggactcaagctccttccctgacagcttgctgcagagagcccttcactgagaggatccaggtgatgcagcctccaaagtaggaatgggcaaggtgtgcacctggaggtgagaggccgctgtcctgggacaccggtggaaggaggtgctgaggaaggtcacaaaagacatgtttatttgacttcattaatatttgaagggtgagctctatgccccaagcagagaaaaaagaagtgaggaactattagcattttttatcatatttaatgggacaaacatctaaggggcagatgtcatagcggttaagaacacggatcttagagttaatcagattgggatcaagtgccaaatttgccagtttctggctgtgagactttggtcaagttactctaccttttcaagcctcagtttatgcatctgtaaagtgaggatgatggtaatcatatccattcactagagtgtgatgcctgatagctagtacacagagcataaaggagagctgggatctgtgcactcacggtcagaggttgtgttgtttcagctccgttctgttccctacttgatgtgtgacttttctttggtccctttgattacctaagcctcagtttcctcatctggaaaaaataaaaacaaaaaaggtcggggcagagggagaatcacttcccagtttggcaaagaaaggtagagatgatggaaaggaaacatttttgtaaactgcaaaatgctgtcaaaatagaagcagagattccagcgagacaggactgatgaatggctgggcattgtcaggcacctcctcgcaggaccctcaaaccattaaggacttgactttgctgtccccagttcttcctctgtctaagacgtgagattcagagatgaaaagtcagggcccactggaaagacgatggagggattcatactggctggaatagcatccaggctctctgttctttgtaatatctgggttatgggtggcatgaagaggaagctgggagaggtggcggcagtgcccaggaagttgacatagagaaggggtgggtggaggaggaggaggggaagagaggatcactttggatatcaggagattgattttggggtttggcaggtgggacatcaggaggatataaggtaattggggaagaaaggaaatttggagaagtgatgctttgggttatgaataggtttcccattaatgtctgtggagagaagcaagaaaagatggtaatttattgctaatcatttttagctgttggaatgtgtgtctttgaatgttattccatgcaaagactgggcactggtgtgcatttgtgcaaattgcaaaggtgttttaaacatcctctgcgaaatgagatatttcatcacggggcagacagtgttttgtagtccacagagtgtttttgaaagtatttttccctttgagtctcttccaagccctctgaaaaagatatggcatgaattattattattattgttattattattttgacagtgcctccctctgtcacccaggctggagtgcagtggcatgatttcggctcactgcaacttccgcctcctgggctcaagcgatcctccacctcagcctcttgagtagctgggactacaggtgcacacgaccatgcccggctaatttttgtatttttagtagagacagggtttcatcatgttggccagggtggtcttgaactcctgacctcaagtaatccacccacctcggcctcccaaaggaaattttataatgtcttcgtcctaagggttcacctttcctgcttgctcttagagtaggattctgaggccttggtcatgcacgttaagcctcagccattcactaactgttaagctttatgattgcctcaatcatttcatttatccatttagggaatgtacataagcactcccctgtgccatgcactgtgttgggcagtggaggtacagcatgcacggtcagacatagtttccagatgaagtaatatgtaaggagattatggaaggatgaacaggaagtagttacgaggacagtcaggaggcaggtggagggaggcatgcaaggcagaagcacccagtatgtcaaagcctggctcagaaaaacacggcaagtttgtggagatcttctcagatgtattgttttgttatcaagtgttcttttgcgtttcatatcttaaactgaatgtaaatggcatacagcccaccgtatctatctgcaataaattgcaaataattacatgttataagtaaaagttaccaagaggccacaagaagttgttttaatttattgttcattttaacccgattttcccaagtgtgtcattgatttttgaatttttaatattttttctggagttcatgttaagacataccagaagccagcaattctgttgttctattttactaaatattagttattttccaaataaattattggcaatgtatgttaacaaatattaagttgacaaagtaacttattgaactatcaccatatttttattcttaataaacttcatcaattacatggtacatatatgccattcaagatcgacattcttttagaatactacagagttatttccactttaaagcagagaaaattgaggcacaggatgattcaatgatttgcccctgtcctcctgccaataaagggtcaaactggaatcagaagtcagcttttctgatggaggctaactcctgtaaaatcgcatgtggagaaaggactcttgtgtttgacagtctaagggccttttctgcctaatctaaggtctgtttccctatatgcaggctgggaggggtgattgtgcagagggacccttggagaactgttacattatgcaaacttgattatcctgtctgacattattgatgtcagcagccattgtgaaatgaagtttgggagatggagtgtggaaggtggcacttgtaatttttaataatcatcctcttttacttcttggggggaggcagtgggggagaaacagagcttcagggttgtggatgctttaatggaatctgtctgtcacaataaggaagtagagaaagtcttttagcgttctacaggctaaatcacagggcttgaaccatggtgtttttggtgaacagagatgccgtaccataaaggcagatggagaatgactgcagggtcaatgagattgtcaccccccgcggcagggacaatgtttattcatctctgaaatcctagtgcccttcacagggcacttagctggagctggtccagtgagagctgattccaaatacactctataaaggaccttgtctgtgtagaattttggcatctcaggcactgtgatgaccactcctcccagttcaaaatctccatatccaactacctgatgaatttctccctttggatcccaaatgaccagaacaggacagataatgtccccttcaagaattttttatcttatgtgaagtccagtgaatggtgttactgtctacccagtcttccaagtaagtgtgacagcttggcatcatttttaaatttccattctcctttgccccacataccagatcattcaccaagcactgcctcttctattttctcatgatctcttgaatttgtccacttccctccatctctaccaacacctccttggaccatgccaacaccatttcttgcatctgcagtttcagcaatctcctaattggtcttcctgccatcaccttcattaatccattctccatgtagtagctggaatgacatctagttaacctttacttaaaacctccatggctcttgaggtcaaagttcaaactcattacatggcctaaggctttttggggtatgatcccaacgaatttctccatctgtctcccatcctgctccctgcctccctatcttcttccagttcctctaatgccacacttccccacacccagcctccactcatgctgtttcttctgccaagaacatccttccctgctcttgcctagccaaatcttgcttattttccatgtctcagtctcagttcttcagtggggacttccctgaataaccgtataagcaaacattaataaagttcttgctatgtgacagatacttgcctttacatagattaacctgttcaatcctcacaataaccctatgacatagataacatacggtctacagttagcagatggagaaactgaggcactaagagataaatgaacttgtccaaggttacatgcaaggtagaagagctgagattcaaatgcaagcgtcttggttccctagtctgtgttttaatcactacaccctgactccagactatgctgagttgtacctgctgtagcctggaattcacttccactgcacccctaatgcttatgcggcattattctcccttctatagttacagcatcacgtggacaggaactgtgtctgtcttgtccacgggtgtgtccgcagtacctgcacaatgcctagcatgtcacaggcactcatgaagatgttttctggttgaatgaataaaagattaaaattctccctaagcatatcagctgttggagccactcttgttcccagtgtgtttcagattcatttgggggcagagagcaaaagtgtctgcatgtggcaggtgagatgcccctatatgaggtgtttggatacagtcgtatgctgaagaagactttacctcttggttggtgtttccctacttccactcccaatatggatggcagccaagctttcattttgcaggtctaagcctctgtgtctagaaaacggaggttttagtgacttgtcttttgcaaaagtaagaattggcagacaccatggcagtgggcgtcctctcttgctgaggacaggaatggggctaggctgcagcatgcctgatgagaagctgctgtgggtggttgggcagttaggcactatttcccatggcctggagagcagc

SEQ ID NO: 155 - DNA, 2505 bp, Homo sapiens
cttggcaaggctaataagaaagcagcttttccaagaaacaatacaatattactggccagatagtattattgattaattcaacaaacagttatgtagcatctactggtaccctggaactgtgctgaactttatagctacacagatgactaagacgcaatttggccttgccagttcatgactgagttatacatgaacagaacaagatcctcatgaaacctctgatatggacatggtcagatgttgaaggccagaggccggctctgctcatctgcacagctgcagcaggacccacgcagggagttaaggatctcgaggaagtgcctccatctgcagcgagtcagtcagcccaagcacgctgtgctctggggagctggggttatggcaagccctttgagccaagaagtgtgaaaaacatacactctactcctgcttacccagatgccacaatgcacagacaactcctggctccggtggaaggaaggatggcagagacattgaatcagaaactccatgttgccaatgtgctggaagatgaccccggctacctacctcacgtctacagcgaggaaggggagtgtggaggggccccatccctcagctctctggccagcttggaacaggagttgcaacctgatttgctggactctttgggttcaaaagcgactccgtttgaggaaatatattcagagtcaggtgttccttcctaaaaaaaaaagtctattttggagaattgaaataattcatggaagggaatcactattcagggatttttcccctttgctcttcttttccctccttaaaagaaaaattaccttctagtcctaggatgaggacacactattagtttgaattaaatgctttgatattctcagatcagccatcttgaaccaaagcaaaaccacaagttacactttcttaaaatttgatttgtcatattttctagagaaacttgaatttaattgtgttattcttagcttccactggcagcctagctttgagggtaaatgaaaatataacccatagattacccagccacttgggaacagcaggtaatactgaagaaaaataaaaatagattttgaaaacgttacttacatttctatgattatgattctgcttccatttaagggaaaacttaggtaaatagagaaattttttctataacatttgtagtcagtatttgaagtgattttttaaaaaataagtattggtccctgttcactttttgattagataaatagataaaatatgttatcttgagaaaaatgattatgctgaaagctttataaacagtatactctttaaaaaatgaagagctgacataatttaacttgtatgtattatgtaagtaaaagagttaggagcctttgaatgagtaagttctgattagattttatctttaaacaaaaccacaaaatttaattggtttttacttgtccacttactgctagtgtcagtttcaggggaagaaatggtttcttttaaaaatcttaataggggacatatgccctaaaaatagtcagttttctagtctgagtaatagataagagactgactaagcaaagtttaaaatgctatttggacactttaatgcacatattggatatctaaaagtctacagccatataaaaattttatataattaatgagcaaatgccgtctctcatgccctaaaataaatcagtagaaacatgtttgctggtgaatcagtgaagcattatgttaaacagtgagttacagctcagagttaaaactttctccttctttttgaagaagctgtgcaaatacttctttttaaggagatctggccttttcctacctggttacctcagtcttcctctgctttgggaagctgaaaaagaagaaaaatcacatttaaagcactggaatgtctgaatgggacgcttgaatgtgtagaacagctgtactgatcctagcatgactcagaggacagtctagggcattttctgggtaattcaggataaaagtatttttttttttaagaaaaatacatgtttttggacaacaaaacaaagtaaacattagtttattcgattgcctccttatacttgcctctttcattctgtcccctgtagatttttaaaaaattatctcattttaaaactttattatttcattttaaataattgacatataataattgtacatatttagggggtacatagtcatgtttcaatacatttacagtgatcagatcagggtggttaacgtaatcattggctcaaacatttttcatttctttgtattggtacggagcattcaatatccatcccccttctagctatctaaaactatgtattattgttaactataggcaacatatagtggtatagagtgctagaacgtattcctcctaggaataatttgctgtaattttgtatcctttaataaatctctccctatccctctttccccccacccttcccagctgctgtgtcctctgttctaccttctacttccgagataaacttggttttagcttcc

SEQ ID NO: 156 - protein, 165 aa, Homo sapiens
MKPLIWTWSDVEGQRPALLICTAAAGPTQGVKDLEEVPPSAASQSAQARCALGSWGYGKPFEPRSVKNIHSTPAYPDATMHRQLLAPVEGRMAETLNQKLHVANVLEDDPGYLPHVYSEEGECGGAPSLSSLASLEQELQPDLLDSLGSKATPFEEIYSESGVPS

SEQ ID NO: 157 - DNA, 417 bp, Homo sapiens
ggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattgggaaaacggaggttttagtgacttgtcttttgcaaaagtaagaattggcagacaccatggcagtgggcgtcctctcttgctgaggacaggaatggggctaggctgcagcatgcctgatgagaagctgctgtgggtggttgggcagttaggcactatttcccatggcctggagagcagc

SEQ ID NO: 158 - protein, 128 aa, Homo sapiens
MLFLSDINDNVPTLRPRSRYMEVCESAVHEPLHIEAEDPDLEPFSDPFTFELDNTWGNAEDTWKLGRNWENGGFSDLSFAKVRIGRHHGSGRPLLLRTGMGLGCSMPDEKLLWVVGQLGTISHGLESS

SEQ ID NO: 159 - DNA, 3835 bp, Homo sapiens
gtttattttgatgttgtggagcgctcaacaggaaaaattgtggatacatccttgattttcaacattaggatcagtgatgtgaatgatcatgcaccccagtttccagagaaggaatttaacatcactgtgcaagaaaaccaatctgcagggcaacctatttttcagatgttagcagtcgatttggatgaagaaaacactccaaattctcaagtcctttacttcctcatttctcaaacaccattactgaaagaaagtggtttccgggttgatcgccttagtggagaaatacgactctctggctgcttagattatgagaccgctcctcagtttacactgctaatcagagccagggactgtggagaaccgtcactgtcatccacgaccaccgttcacgtggatgtgcaagaaggcaacaaccacaggcctgcatttacccaggagaactataaggttcagattcctgaaggccgagccagccagggcgtgttgcgtctcctggttcaagatcgagattctccatttacatcagcttggagagcaaaattcaacatattgcatggcaatgaagaggggcattttgacatttcgactgaccctgagaccaacgaagggatattaaatgttatcaagcctttggattatgagactcgcccagcgcaaagcctcatcattgtcgtggagaatgaggagaggctcgtcttctgtgagagaggaaagcttcagccgccaaggaaggcagcagccagcgccactgtgagtgtgcaggtgacagacgccaacgacccaccagcctttcacccccagagcttcattgtcaataaagaggagggcgccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaagggttatggcaagccctttgagccaagaagtgtgaaaaacatacactctactcctgcttacccagatgccacaatgcacagacaactcctggctccggtggaaggaaggatggcagagacattgaatcagaaactccatgttgccaatgtgctggaagatgaccccggctacctacctcacgtctacagcgaggaaggggagtgtggaggggccccatccctcagctctctggccagcttggaacaggagttgcaacctgatttgctggactctttgggttcaaaagcgactccgtttgaggaaatatattcagagtcaggtgttccttcctaaaaaaaaaagtctattttggagaattgaaataattcatggaagggaatcactattcagggatttttcccctttgctcttcttttccctccttaaaagaaaaattaccttctagtcctaggatgaggacacactattagtttgaattaaatgctttgatattctcagatcagccatcttgaaccaaagcaaaaccacaagttacactttcttaaaatttgatttgtcatattttctagagaaacttgaatttaattgtgttattcttagcttccactggcagcctagctttgagggtaaatgaaaatataacccatagattacccagccacttgggaacagcaggtaatactgaagaaaaataaaaatagattttgaaaacgttacttacatttctatgattatgattctgcttccatttaagggaaaacttaggtaaatagagaaattttttctataacatttgtagtcagtatttgaagtgattttttaaaaaataagtattggtccctgttcactttttgattagataaatagataaaatatgttatcttgagaaaaatgattatgctgaaagctttataaacagtatactctttaaaaaatgaagagctgacataatttaacttgtatgtattatgtaagtaaaagagttaggagcctttgaatgagtaagttctgattagattttatctttaaacaaaaccacaaaatttaattggtttttacttgtccacttactgctagtgtcagtttcaggggaagaaatggtttcttttaaaaatcttaataggggacatatgccctaaaaatagtcagttttctagtctgagtaatagataagagactgactaagcaaagtttaaaatgctatttggacactttaatgcacatattggatatctaaaagtctacagccatataaaaattttatataattaatgagcaaatgccgtctctcatgccctaaaataaatcagtagaaacatgtttgctggtgaatcagtgaagcattatgttaaacagtgagttacagctcagagttaaaactttctccttctttttgaagaagctgtgcaaatacttctttttaaggagatctggccttttcctacctggttacctcagtcttcctctgctttgggaagctgaaaaagaagaaaaatcacatttaaagcactggaatgtctgaatgggacgcttgaatgtgtagaacagctgtactgatcctagcatgactcagaggacagtctagggcattttctgggtaattcaggataaaagtatttttttttttaagaaaaatacatgtttttggacaacaaaacaaagtaaacattagtttattcgattgcctccttatacttgcctctttcattctgtcccctgtagatttttaaaaaattatctcattttaaaactttattatttcattttaaataattgacatataataattgtacatatttagggggtacatagtcatgtttcaatacatttacagtgatcagatcagggtggttaacgtaatcattggctcaaacatttttcatttctttgtattggtacggagcattcaatatccatcccccttctagctatctaaaactatgtattattgttaactataggcaacatatagtggtatagagtgctagaacgtattcctcctaggaataatttgctgtaattttgtatcctttaataaatctctccctatccctctttccccccacccttcccagctgctgtgtcctctgttctaccttctacttccgagataaacttggttttagcttcc

SEQ ID NO: 160 - protein, 623 aa, Homo sapiens
MLAVDLDEENTPNSQVLYFLISQTPLLKESGFRVDRLSGEIRLSGCLDYETAPQFTLLIRARDCGEPSLSSTTTVHVDVQEGNNHRPAFTQENYKVQIPEGRASQGVLRLLVQDRDSPFTSAWRAKFNILHGNEEGHFDISTDPETNEGILNVIKPLDYETRPAQSLIIVVENEERLVFCERGKLQPPRKAAASATVSVQVTDANDPPAFHPQSFIVNKEEGARPGTLLGTFNAMDPDSQIRYELVHDPANWVSVDKNSGVVITVEPIDRESPHVNNSFYVIIIHAVDDGFPPQTATGTLMLFLSDINDNVPTLRPRSRYMEVCESAVHEPLHIEAEDPDLEPFSDPFTFELDNTWGNAEDTWKLGRNWGQSVELLTLRSLPRGNYLVPLFIGDKQGLSQKQTVHVRICPCASGLTCVELADAEVGLHVGALFPVCAAFVALAVALLFLLRCYFVLEPKRHGCSVSNDEGHQTLVMYNAESKGTSAQTWSDVEGQRPALLICTAAAGPTQGVKGYGKPFEPRSVKNIHSTPAYPDATMHRQLLAPVEGRMAETLNQKLHVANVLEDDPGYLPHVYSEEGECGGAPSLSSLASLEQELQPDLLDSLGSKATPFEEIYSESGVPS

SEQ ID NO: 161 - DNA, 2511 bp, Homo sapiens
gtttattttgatgttgtggagcgctcaacaggaaaaattgtggatacatccttgattttcaacattaggatcagtgatgtgaatgatcatgcaccccagtttccagagaaggaatttaacatcactgtgcaagaaaaccaatctgcagggcaacctatttttcagatgttagcagtcgatttggatgaagaaaacactccaaattctcaagtcctttacttcctcatttctcaaacaccattactgaaagaaagtggtttccgggttgatcgccttagtggagaaatacgactctctggctgcttagattatgagaccgctcctcagtttacactgctaatcagagccagggactgtggagaaccgtcactgtcatccacgaccaccgttcacgtggatgtgcaagaaggcaacaaccacaggcctgcatttacccaggagaactataaggttcagattcctgaaggccgagccagccagggcgtgttgcgtctcctggttcaagatcgagattctccatttacatcagcttggagagcaaaattcaacatattgcatggcaatgaagaggggcattttgacatttcgactgaccctgagaccaacgaagggatattaaatgttatcaagcctttggattatgagactcgcccagcgcaaagcctcatcattgtcgtggagaatgaggagaggctcgtcttctgtgagagaggaaagcttcagccgccaaggaaggcagcagccagcgccactgtgagtgtgcaggtgacagacgccaacgacccaccagcctttcacccccagagcttcattgtcaataaagaggagggcgccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaaggcttacccagatgccacaatgcacagacaactcctggctccggtggaaggaaggatggcagagacattgaatcagtctaaagagagaaatcgcttcagcctcagcaggggctgcatcatcccccagggaagagccacagctgggcgaggattgccacaagacatttacaaggagatgatgccacggagactaacgcagactggtaaacggaaacacggggctttggctcgaacaccctctttcaagaaagttgtttatgaccacaaggaagatgaggagaacaaggctgggagaaagcaaaggagccacttgtttaaggttatgcagctgagaaatgaacaaggtggggttcgagtccagagtgcgcattccccatcaccccttaacaaaaaggcatgtttcccaggagactacagaggagaatcggcaggtggtcacaattgcagggctgtctcaggctgagcagagagtacggtggaggggcatgggcctgctgttggcggtgagggccttggaaatggcttcctggaggagatggcaattatccaggtagacaagatgtgtgtgtgtgtgtgtgtgtgtgtgtgtgtgtgtgtgtgatcatgaagaagaaataatgtgcaaagccctggtcataaataacttttcctctgcaaactgtggatggcagttcaccatgtttctcaccactggcctggtcactgcttatccaatatgcatgtaagaattactttttctcttttttcccttctataaattctcatagaacttcctttaatgcattaaaaaagcaactagcatgttcaa

SEQ ID NO: 162 - protein, 666 aa, Homo sapiens
MLAVDLDEENTPNSQVLYFLISQTPLLKESGFRVDRLSGEIRLSGCLDYETAPQFTLLIRARDCGEPSLSSTTTVHVDVQEGNNHRPAFTQENYKVQIPEGRASQGVLRLLVQDRDSPFTSAWRAKFNILHGNEEGHFDISTDPETNEGILNVIKPLDYETRPAQSLIIVVENEERLVFCERGKLQPPRKAAASATVSVQVTDANDPPAFHPQSFIVNKEEGARPGTLLGTFNAMDPDSQIRYELVHDPANWVSVDKNSGVVITVEPIDRESPHVNNSFYVIIIHAVDDGFPPQTATGTLMLFLSDINDNVPTLRPRSRYMEVCESAVHEPLHIEAEDPDLEPFSDPFTFELDNTWGNAEDTWKLGRNWGQSVELLTLRSLPRGNYLVPLFIGDKQGLSQKQTVHVRICPCASGLTCVELADAEVGLHVGALFPVCAAFVALAVALLFLLRCYFVLEPKRHGCSVSNDEGHQTLVMYNAESKGTSAQTWSDVEGQRPALLICTAAAGPTQGVKAYPDATMHRQLLAPVEGRMAETLNQSKERNRFSLSRGCIIPQGRATAGRGLPQDIYKEMMPRRLTQTGKRKHGALARTPSFKKVVYDHKEDEENKAGRKQRSHLFKVMQLRNEQGGVRVQSAHSPSPLNKKACFPGDYRGESAGGHNCRAVSG

SEQ ID NO: 163 - DNA, 2760 bp, Homo sapiens
ctacggcgatccaagagaagatgggttatcaccaccttggagctggaggaggaagacccgggaccctttcccaaactcattggtgagctgttcaataatatgtcttataacatgtcactaatgtatctaatcagtggacctggtgtggatgaatatccagagattggtttgttttctctagaagatcatgagaacggaaggatatatgttcaccgccctgtcgatcgagaaatgacaccatctttcacggtttattttgatgttgtggagcgctcaacaggaaaaattgtggatacatccttgattttcaacattaggatcagtgatgtgaatgatcatgcaccccagtttccagagaaggaatttaacatcactgtgcaagaaaaccaatctgcagggcaacctatttttcagatgttagcagtcgatttggatgaagaaaacactccaaattctcaagtcctttacttcctcatttctcaaacaccattactgaaagaaagtggtttccgggttgatcgccttagtggagaaatacgactctctggctgcttagattatgagaccgctcctcagtttacactgctaatcagagccagggactgtggagaaccgtcactgtcatccacgaccaccgttcacgtggatgtgcaagaaggcaacaaccacaggcctgcatttacccaggagaactataaggttcagattcctgaaggccgagccagccagggcgtgttgcgtctcctggttcaagatcgagattctccatttacatcagcttggagagcaaaattcaacatattgcatggcaatgaagaggggcattttgacatttcgactgaccctgagaccaacgaagggatattaaatgttatcaagcctttggattatgagactcgcccagcgcaaagcctcatcattgtcgtggagaatgaggagaggctcgtcttctgtgagagaggaaagcttcagccgccaaggaaggcagcagccagcgccactgtgagtgtgcaggtgacagacgccaacgacccaccagcctttcacccccagagcttcattgtcaataaagaggagggcgccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaaggcttacccagatgccacaatgcacagacaactcctggctccggtggaaggaaggatggcagagacattgaatcagtctaaagagagaaatcgcttcagcctcagcaggggctgcatcatcccccagggaagagccacagctgggcgaggattgccacaagacatttacaaggagatgatgccacggagactaacgcagactggtaaacggaaacacggggctttggctcgaacaccctctttcaagaaagttgtttatgaccacaaggaagatgaggagaacaaggctgggagaaagcaaaggagccacttgtttaaggttatgcagctgagaaatgaacaaggtggggttcgagtccagagtgcgcattccccatcaccccttaacaaaaaggcatgtttcccaggagactacagaggagaatcggcaggtggtcacaattgcagggctgtctcaggctgagcagagagtacggtggaggggcatgggcctgctgttggcggtgagggccttggaaatggcttcctggaggagatggcaattatccaggtagacaagatgtgtgtgtgtgtgtgtgtgtgtgtgtgtgtgtgtgtgtgatcatgaagaagaaataatgtgcaaagccctggtcataaataacttttcctctgcaaactgtggatggcagttcaccatgtttctcaccactggcctggtcactgcttatccaatatgcatgtaagaattactttttctcttttttcccttctataaattctcatagaacttcctttaatgcattaaaaaagcaactagcatgttcaa

SEQ ID NO: 164 - protein, 771 aa, Homo sapiens
MSYNMSLMYLISGPGVDEYPEIGLFSLEDHENGRIYVHRPVDREMTPSFTVYFDVVERSTGKIVDTSLIFNIRISDVNDHAPQFPEKEFNITVQENQSAGQPIFQMLAVDLDEENTPNSQVLYFLISQTPLLKESGFRVDRLSGEIRLSGCLDYETAPQFTLLIRARDCGEPSLSSTTTVHVDVQEGNNHRPAFTQENYKVQIPEGRASQGVLRLLVQDRDSPFTSAWRAKFNILHGNEEGHFDISTDPETNEGILNVIKPLDYETRPAQSLIIVVENEERLVFCERGKLQPPRKAAASATVSVQVTDANDPPAFHPQSFIVNKEEGARPGTLLGTFNAMDPDSQIRYELVHDPANWVSVDKNSGVVITVEPIDRESPHVNNSFYVIIIHAVDDGFPPQTATGTLMLFLSDINDNVPTLRPRSRYMEVCESAVHEPLHIEAEDPDLEPFSDPFTFELDNTWGNAEDTWKLGRNWGQSVELLTLRSLPRGNYLVPLFIGDKQGLSQKQTVHVRICPCASGLTCVELADAEVGLHVGALFPVCAAFVALAVALLFLLRCYFVLEPKRHGCSVSNDEGHQTLVMYNAESKGTSAQTWSDVEGQRPALLICTAAAGPTQGVKAYPDATMHRQLLAPVEGRMAETLNQSKERNRFSLSRGCIIPQGRATAGRGLPQDIYKEMMPRRLTQTGKRKHGALARTPSFKKVVYDHKEDEENKAGRKQRSHLFKVMQLRNEQGGVRVQSAHSPSPLNKKACFPGDYRGESAGGHNCRAVSG

SEQ ID NO: 165 - DNA, 2814 bp, Homo sapiens
ctacggcgatccaagagaagatgggttatcaccaccttggagctggaggaggaagacccgggaccctttcccaaactcattggtgagctgttcaataatatgtcttataacatgtcactaatgtatctaatcagtggacctggtgtggatgaatatccagagattggtttgttttctctagaagatcatgagaacggaaggatatatgttcaccgccctgtcgatcgagaaatgacaccatctttcacggtttattttgatgttgtggagcgctcaacaggaaaaattgtggatacatccttgattttcaacattaggatcagtgatgtgaatgatcatgcaccccagtttccagagaaggaatttaacatcactgtgcaagaaaaccaatctgcagggcaacctatttttcagatgttagcagtcgatttggatgaagaaaacactccaaattctcaagtcctttacttcctcatttctcaaacaccattactgaaagaaagtggtttccgggttgatcgccttagtggagaaatacgactctctggctgcttagattatgagaccgctcctcagtttacactgctaatcagagccagggactgtggagaaccgtcactgtcatccacgaccaccgttcacgtggatgtgcaagaaggcaacaaccacaggcctgcatttacccaggagaactataaggttcagattcctgaaggccgagccagccagggcgtgttgcgtctcctggttcaagatcgagattctccatttacatcagcttggagagcaaaattcaacatattgcatggcaatgaagaggggcattttgacatttcgactgaccctgagaccaacgaagggatattaaatgttatcaagcctttggattatgagactcgcccagcgcaaagcctcatcattgtcgtggagaatgaggagaggctcgtcttctgtgagagaggaaagcttcagccgccaaggaaggcagcagccagcgccactgtgagtgtgcaggtgacagacgccaacgacccaccagcctttcacccccagagcttcattgtcaataaagaggagggcgccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaagggttatggcaagccctttgagccaagaagtgtgaaaaacatacactctactcctgcttacccagatgccacaatgcacagacaactcctggctccggtggaaggaaggatggcagagacattgaatcagtctaaagagagaaatcgcttcagcctcagcaggggctgcatcatcccccagggaagagccacagctgggcgaggattgccacaagacatttacaaggagatgatgccacggagactaacgcagactggtaaacggaaacacggggctttggctcgaacaccctctttcaagaaagttgtttatgaccacaaggaagatgaggagaacaaggctgggagaaagcaaaggagccacttgtttaaggttatgcagctgagaaatgaacaaggtggggttcgagtccagagtgcgcattccccatcaccccttaacaaaaaggcatgtttcccaggagactacagaggagaatcggcaggtggtcacaattgcagggctgtctcaggctgagcagagagtacggtggaggggcatgggcctgctgttggcggtgagggccttggaaatggcttcctggaggagatggcaattatccaggtagacaagatgtgtgtgtgtgtgtgtgtgtgtgtgtgtgtgtgtgtgtgatcatgaagaagaaataatgtgcaaagccctggtcataaataacttttcctctgcaaactgtggatggcagttcaccatgtttctcaccactggcctggtcactgcttatccaatatgcatgtaagaattactttttctcttttttcccttctataaattctcatagaacttcctttaatgcattaaaaaagcaactagcatgttcaa

SEQ ID NO: 166 - protein, 789 aa, Homo sapiens
MSYNMSLMYLISGPGVDEYPEIGLFSLEDHENGRIYVHRPVDREMTPSFTVYFDVVERSTGKIVDTSLIFNIRISDVNDHAPQFPEKEFNITVQENQSAGQPIFQMLAVDLDEENTPNSQVLYFLISQTPLLKESGFRVDRLSGEIRLSGCLDYETAPQFTLLIRARDCGEPSLSSTTTVHVDVQEGNNHRPAFTQENYKVQIPEGRASQGVLRLLVQDRDSPFTSAWRAKFNILHGNEEGHFDISTDPETNEGILNVIKPLDYETRPAQSLIIVVENEERLVFCERGKLQPPRKAAASATVSVQVTDANDPPAFHPQSFIVNKEEGARPGTLLGTFNAMDPDSQIRYELVHDPANWVSVDKNSGVVITVEPIDRESPHVNNSFYVIIIHAVDDGFPPQTATGTLMLFLSDINDNVPTLRPRSRYMEVCESAVHEPLHIEAEDPDLEPFSDPFTFELDNTWGNAEDTWKLGRNWGQSVELLTLRSLPRGNYLVPLFIGDKQGLSQKQTVHVRICPCASGLTCVELADAEVGLHVGALFPVCAAFVALAVALLFLLRCYFVLEPKRHGCSVSNDEGHQTLVMYNAESKGTSAQTWSDVEGQRPALLICTAAAGPTQGVKGYGKPFEPRSVKNIHSTPAYPDATMHRQLLAPVEGRMAETLNQSKERNRFSLSRGCIIPQGRATAGRGLPQDIYKEMMPRRLTQTGKRKHGALARTPSFKKVVYDHKEDEENKAGRKQRSHLFKVMQLRNEQGGVRVQSAHSPSPLNKKACFPGDYRGESAGGHNCRAVSG

SEQ ID NO: 167 - DNA, 13938 bp, Mus musculus
ctttgtctgagttgaagtgaagttgtagagattttcagactggagtcagcaatcaccggtgtttagtctgcagcggagcagagaaaaggaaaggggggaaaatcaagaatcgcccgggaaacacagactgcagactccgccagcaccctgcaatagatggggacggagtccacgcggggagccaggccgaggtgacacgctgctcccagccaggaggaccagcggccacccctaccaggaagggacttcacgctcctatctggaagtcgccaaacggtgtgtatgaaaactgaagtttgcgagctgtttaattgctgtgtgattaagagtcgctttcaagactctgagacccgatgtggcttagagctctgagtggctgggaggaagttgaagggattgctgggctcttctaactcgccctgagaagggaatctagcaactgaccaatgcaccaaatgaatactaaaatgcactttagatttgcacttgcacttctgatggcgtttttcagccacgatgtcctggctaagaatctgaaatacaggatttatgaggagcagagggtcggatcggtaattgctagactatcagaagatgtggctgatgttttattgaagctaccaaatccttctgctgttcgttttcgagccatgccacgggggaattctcctctcctggtcgtaaatgagaataccggagaaatcagcataggggctaaaattgaccgcgagcaactatgccaaaaaaacttgaactgttcgatagagtttgatgtgctcactctgccgaccgagcatctgcagctgttccacattgaagtggacgtgctggacattaatgacaattccccccaattctcgagacccgtcattcccattgagatatcggagagcgcagcagttgggactcgtatccccctggacagtgcgttcgacccagatgttggggaaaattccctccacacctactcgctctctgctaatgattattttaatatcgaagtgcgaaccaggacagacggggccaagtacgctgaactcatagtggtgaaagagttggatcgggagctgaaggctagctacgagcttcagctcacggcctccgacatgggagtgcctcagaggtctggctcctccatcctgaaaatcagcatttcggattccaacgacaacagcccggcctttgagcagccttcttacacaatacaactcttagaaaactccccagttggaaccttgctccttgatctaaatgccaccgatccagatgagggcgctaatgggagaattgtgtattctttcagcagtcatgtgtctcccaaaattatagagacttttaagatcgactcagaaaaaggccacttgactcttttcaagccagtggattatgaaatcaccaagtcctatgagatagacgttcaagcccaagatttgggtcccaattccattcctgctcattgcaaaattataattaaggttgtggatgtcaatgacaataaacctgaaattagcataaatctcatgtcccctggaaaagaagaagtatcttatgtctttgaaggggatcccattgatacattcgttgctatcgtcagggttcaagacaaggattctgggctgaatggggaaataatctgtaagcttcatgggcatggacattttaaacttcagaagacatatgaaaataactacttgatcttgaccaatgccactctggatagagaaaagagatctgagtatagtttgactgtgattgctgaggacaagggaacaccaagcctctcctcagtgagacattttactgttcaaatcaatgacataaatgacaatccacctcgcttccagaggagccgatatgaatttgtcatctcagagaataattcaccaggggcgtatatcaccacagttacagccactgatccagatcttggtgaaaacggacatgtgacatacaccattttggagagttttgtcttgggaagttccatcaccacgtatgtaaccattgacccctctaatggcgccatctatgccctcaggatctttgatcatgaagaagtgagtcagatcacttttgtggtggaagccagggatggagggagtcagaagcaactctccagcaacaccaccgttgtgctgaccatcattgatgagaatgacaatgtccctgtggttatagggcctgcaatgcacaataatactgcagaaatatccatccccaaaggagctgaaagtggttttcatgtcacaagaataagggtggtcgacagggactctggtgccaatgctgaattcagctgctccatagtatctggtaatgaggaaaacatctttatcatggaccctaggtcatgtgacattcataccaacgtcagcatggaatccattccctctgcggaatgggcactctcagttatcatccaggacaagggcagtcctcctctgcacaccaaagtccttctgaggtgcatggtctttgactatgcagaatctgtgacaagcacagccatgacctctgtcagccgcgcatccttggatgtgtccatgatcataattatttccttgggagcaatttgtgctgtgttgctggttattatggtcctgtttgcaacgaggtgtaatagagaaaagaaagacaccagatcctacaactgcagggtggcagaatccacgtaccagcatcatcctaaaaggccatccaggcagattcacaaaggagacatcacactggtacccaccatcaatggcactctgcccatcagatctcaccacagatcctccccatcttcatccccaaccttggagaggggacaaatgggcagccgccagagtcacaacagtcaccagtcactcaacagtttggtgaccatctcatcaaaccacgtgccagagaatttttcattagaactcacccacgccactcctgctgttgaggtaagatcagacactacagggcctggtcaagccagatgctgatgctcagaggctgcacagtcatcacacctttaaggttgtcgttgatagatgacagtaggcagttccactagaactcaagccacagggtggacctatctcaagtacaccgtctggcttatttctatttttataaataattcacttgtgggtgttaggtgtgatgtctcacacggggctgttaatcagagtccctgcacttctcagagtaagatgctgagacaggaaaaaataaaacctaaagggacccagctattctcattgttaaaatttctcctgagaaatcaacaccctggctcttgagaatctcactccaattgcatgctgtctttggaaaactttgtgcagttttctggctttctggcattgtctcattatctgaactaacagtgtattttactgagtttttattttattttatttatttatttttacagttttatctaaactgtaaaggaaggcagttatttaaaagtctttcaagcaggaacaactcacttgtgttttgagagcagccagatctctctgtaatggatcttaactgggtttggtgtctggctgtgccctcttcatggtctagcataagtaaacccctgacagatagaaagtgtgagcttagcattcccttttcttccttaatgcacgtgaatgcgtgaggagtgtttttttctgtttcccccagaagtcagttctgtctctttggtttccagcaggtctcgcagcttctctccatgcttcaccaggggcaatatcagccacggccaagttttcgaggaaacaaatattccaggagctataggtatgaattaccctggtgtcagctgctaagtctcggggaacttaaatgccgaagagtaaaaaactgtgtgtttctttcactgatctttctagatatgcccttcaagacatggataaatttagcctgaaagacagtggccgtggagatagcgaagcaggagatagtgattatgatttggggcgcgattctccgatagacaggctcctgggagaaggattcagtgacctcttcctcacggacgggagaattccagcaggtaagagggccgtgatagctaaatctttattttcacagctaccacagagccaggatgacgaacagcttctcccatgcttctgtttctgctgtccttttcctttacactggaaataggtgggatctctgcactattagcagtggacaagcgtgagacatttaatttttttttttcttctcaaaatccacaataagcagttggtagagaaggaatgaatgtgaaggcttaataggagaaggaaggggagagagcactgaaagaagaccaagccccgcccccctccctctttcttatccagccagtgccattgggcgctcctaagcaactccagaaaattgctaggtgcctgtttgtattcagacagcctgttcggtggatagtggtgaactggactataatttggaggatgcatttcctgtgatgggaaccaactcacaaaatcaagagcctaaaatacactggaaagggtatattttaagcactaaaaataggcaaaggaatgtacctttggaggtggtgtgcagagcgtatttcatgccccctctcattttgagtcggtacagcaatagaggagggaaacacacccagagggggatttataaagcacacagccaggtggaggaaattctattaagtttcgaatcaattttttccttagtgactcttgcctctaattgtgccctaggaacttggatccaactgagcaaatgctgagaagatcagtagctgccctgttgctaggggctgtagaaagaaatcaacacttaggagtactgaagtttgcctctgactgtccacacgtcttaattcactgattgtcaacccaatgactgccattcgcaatacacgtaggaaaaaggaacaaaactttactagtgtctgtatttatttatttatttacttgtaaagatgaagaaactaggatagaaaacatgagagaattaaccagaaattaatttggggaaattcagaaaataggattttagctctcatgagttataggaatcacagtagcactagctaactagcagaggttcttactagcagtgccctggggtatcctctgggctaagactgagtactctgggttcatatggagtcaggctttgccatgttatttatggtgctggctgttggcttaacatacatttcagtgactaagctcttacagtttaaagctcattgggcttagttatcctggtgttggtgacattagtgttcttatgtgttttgagatttgaaaattggaagcttatatagattataacaatgtaaaccaggcaggtaggctgtgcctggtcgcaatgaggcagtgagatccgacccaatttccccacccttaatcattcatctaggacatatataaagtaactagtgttttgcttttttaaaaaatctagcttgtttgtcccctgacctgtttccttccctgcacatgtgcatatatgtttgccttagtgtgctcatggtggggctgagaaagtaatggctgtcttcctctattttctttgccttgttgccttgagagagaatgtcttcatccaaagctcgtggatacagctagctagctggccagcaagctttcagtgtgcctgtctctgcccagagaggcacaggcagccatatcatgcttgtaatgggtgctggagaataatcctcggatcctcataccctcacccactgaaccgacaccctagatacttatttgcttttatgtttgaagacatacccacctctttgaaaccactagatgttgcttgtttagttatatgattacaagaccagatagtttatctctggctagacaaatgtataggaaggatatctagtcgcaatgaagcctactagctgcatagcagcctgtatttctacagtcacccatggaatctatccttttcaatgtgtaggtcagaccagttggaagacaaatctatgaaatagctaaaggaacatgtatgccccaagacatcgtgctcaatgacaatgagttttattattctggcttatataatgaagcagctggttgaatttctatggttctgagatatgatgctgacaggggcctacactagaatagcagaatttcccagattaggttatttcataaacaaagacacatgggcatgtcatcaatatttcggtagacattttaaaaatgcacagggttcatttgttggaattttaatttatcatagcaataaaatggagaatacaaatacacagttctaaaatcccatttgtggatctacacatctgagattttttaagctccaaaataatataatttaaatggttaacattagtgtattattttatgtacttatgcattcattcattcattcattcattcacttattccttaattacagtcctgggaattgaactcacagcacaacacaaatcaaaactttgctttgcatctttgcaatgcgtctcatctctctctttttccttttgaagattaaaagcagttattttccatcttccctatatttccaaagttaccatatttccatatattccttgtagcagaattatctagtacttgaattaaacaataatcagtactaatagtaataaatattagacaataaagaggtaggcaaagttaaactatagaaaatagtgaatcctgcctactatgtgtctttacctttatcaatattacattgttgtttaaaattatagacttcatgtgtgtgtgtgtgtgtgtgtgtgtgtgtgcgcgcgcgcgtgcacgcatgcacgcatacatgagctcagatgtctgtgtttccaactaactatgtcataggagctgtatttctacctctgttgctttctacttctacatagggttgaaccattttcaagtttcggagcagtggggcatgagcagtggttggtgatgataccattatgttagtgttttgctagcaaggactgccatgcatactgagcatctacagagataaccatcttttaatcaagagcatcactgtgatgacgccacgtcgatatcctagatttatcttcattctagcaactcctgcaggcgtgctagggtgtaaaacttgtggtctgcaaaagtttcctactcaggaaatactacgagcagagaaaaatgtcggtccacatctgaatcttattaacagagctcagcacaattttctaaagtatgtgtatttttaggacgtaagtgttgtgttccaactgttttttctgcattgatttgtgaacaaatatagatcctgttgcattgcatggcttgccaaaagggtcatttctggtcattcatccttctaattcccacacaaatgtagggttttgtgttttgggttttttttcctgctaaacaaacatgcatttttatctgttgattcatgtttgtcagctcttttttttcttcccaactttgaactccaacactaaacacgggtgtataacgcctccatgtttccagtgaaagttgttgacaatagaaggtttgtaaaagctcccccacctagacttcctctaccttccctgattgtccctgtttcacttttcagcatctttcatctgtgagggcttcaaatactcattattcattctgctctctgttctcagtaggagtcttagctggttcccctccttcctctagtggctcatttcctgtagcaactggcaggctcctattccagttcttgtggccactcctactttcaaatctttacttcatacagttttcacaaccttttcagggcgctttaacattcttttttttttttttaactcaaagtcaatctctgactctcgttgctcagcaacactgagcacatctattatctttgtattcaaagtccactgaaatgcgctctcagcctgttctcagttttgccagttttgaatcctttgcatcagacagagaggcttctcttcctccagcatgccaatgctttgtgcacactgccctttctccatggcaaatgcctcttcttcaattcctgtgcccaattctgcttacctgctgtcttttgaaatagcagtcctcatatccatttctcttcctttctgaacatttcctgagcatcatctcatttgctcctttacctgggtgactcaaatagcatttgttatatttggcttagaactagattgcagtcccattgacagccaggcactgaaatggcccctatttgatgggctcttcaaggataacttactagttactccataggtaatgacttgtttcaagctctatcttgtactcactgcactgccttctatcctacttgtaaggtacaggacagtaataaagtttacagaggagctacaatttctacctgtcctgatcgccacaaaaactatcacctgacagggcttttagatagtcccaagaagagcagaagcaataggtactgctcagcttttcttgatccttgtatatgggatgaaacattttcagcactgaaacacacatacactgtcacgcaaccaaatctcagtggataggagtgagattagaacacccatagcaatgagtgtactttcttctgtttctctcctggtcctttttatttcatcaccccctccccttttgtcttcactgtctctatctacctagtgtttgctatcctttctattaatctcctctctatctttctttttcaattttcatgagtttgtgcatcgtgtccatgtgtgtctacgtatgtttgcatgtatgtgggtatttgtatgtagtgtgtacctgtcttagtgagggttttgctgttgggaacagtcaccaataccaacataacacttataaggaggactacatttaattggggctggcttataggttcagaggttcagtccattatcatcaaggagggaacatggcagtgtctatgcaggcataatgcagaggagctgagagttctagatgttcatctgaaggctgctagcagaatagttgcttccaggccactagaactagggtattaaaacccacacccacagtgacacacctactccaacaaggccacatctccaaatagtgccactctctgggccgagcatatacaaaccatcacattccactctctggcttgctcagcttgctttcttatagaactcaggactaccagcccagggatagctccacccacaataggcctctcacccttgatgactgagaaaatgccttacagttggatctcatggagggatttcctcaagggaggcttcttgctctgtgaggactctacctgtgtcaagttgacacacaaaaccagccagtacactacccatgcatgtagaatcctgtaataatgcctgcaatcatcctcaatagctcttctatcccattcaatgaggcagaatcttacaagaaacccagagcttctgatgtaagtactctagttggccagtgtgttcttgggacaccttgtctctactacccaaggctggggtgacaggtgagccaccacattcccctggcatgttcatcaattctgaggatcctaaatccagcccttatacttgtccagcaagtgctctagccactgagcatgtttcttgctctcctttacgtttttaagttgattaattataattaatatgtgtgtgtgtgtgtgtgtttgtgtggttctgtgtgtgtgtgtatatatgtgtatatatatatcaccatatacatatatggtgttataaatgcctttcactatttaacaaccactcctaagatgttggtgttagtcatgtgggccatgctgttctattatcctgctgcttacatgctcagtgcattcaggttatgagaaaagatgcatatggtcaagattcgtagaatcccgggtaatgttttcatcctcattataggaaatcgaagccaagtaagacaatacaaaaagatgttcttcctaagcctaaagccacagagctgagggccagaacaacaatgccaggtctgttctcctttctcccatcaggatggaggcagtcaatatccacaggcctcatttccatgatcagaggctcagaggtcaaagcaggggtgtggggtgtggatatcgccactgtgataattctctactgagaaccctaggtgctgtttttaaggtataccagttgctcttcaataccctttgctgttttctccactggacgagttaaaacaggcttggcaaatatttccatacagtgtaattaatacctgaaggatgatcatctaaacctgagttttatcgaaatcactctgtttattcagatgactctctcaccacagcataatgacacagtcagccctcgaagaacagaggtccctgcctggatgctcttacacgtcccctggtgttttcgtatgcttttgaatttctagattcttatacttgaaacccttctcttatagcacttagtctcagttttttattttgttttattttgcctgtttttctttccatattttttccttttaaactaagaatggaggtcctgagggagctaaagaccaaaattagcatagaggtcagagataaagaatagtgacttccacacagttaaaaatcatttatccttttctgcttactctcatccagaactacagtgcccatatgctctgtgcagttcctttaccagactgtgggcatagtacacatagtaggtggtttgtttcccctagcaacgagtgtggcatggcataacttcagcagtgacaaagctggaaatctgctctcagcagctgcatctacaaactcagtgcccaacatatatgcctgtgcttagcatcagtcctgatttcttttagatacaaagatactttacattttctataattctgtccttggtcttaaaatgaaatggtattgaaaagtccaagttttctctgaaggaagtggttgtcatatggaatacatttcatatctttgcatatcaatttttaatgtgttttagcaactctatatactgaatttaggatccccttcttttatttttctgctttgctcagttgtagtggtttctatgagtttggccactcacattccactagggaactggaacatatgggaaaatcaaagaaagtacttttcatattcttcagcttccaatgactttttcatgcaattgaatattaatgtatttagaccctaaataagtattttatagcaggacaattcaggatacctaaggtactgattcagagcacttagaattgctatttgaatagaccagtgagtaatggatacaaaccgtaaggaagacaagatacccccaggatggggtggtacccaagggagttccccttctctgaggagaagggatagggggtagtgcaggtggggcttttaagggtgggactgggaagaggggatggagggggtctgtgagtgggatgtaaagtgttttttaaaaagagagagggggagcgagagagagagagagagagagaggaaggaaggaaggaaggaaggaaggaaggaaggaaggaaggaaggaaaagagaatgataaggacactaaccagagaactgacgttttcagtgcaggccaagtccttattttcaagacagcaaaaaatactttacagagattgcctggtattattctaaattgaagagctcgccctcagctctatttccagctgttgctgttgtacagtttatgttcatcttttgttggattacctaagccttagctttgtttggacatgttcacatataaataatgaactccgtattatatttctgaaatttactgttgaccactaaaaatgattattcgctttcttttattaaacggaagactataacacaaacatgacatctggtccagagagccaacatacaactgaaacatataaccgtagcctatctaatgttcctaacaacagattaacattatgattctagcacaaaacctctttctaccttaagaataagatgacatttcccattgctatggatgatgccttgtttaataacggactctccttgctttgtttgttctcagcaatgaggctatgtacggaggagtgcagagtcctgggccactctgaccagtgctggatgcccccgctgccctcgccatcctctgactacagaagcaacatgttcatccccggagaagaattcccagctcaacctcagcaacagcattctcatcagggccttgatgatgacagccagcctgcagaaaacggggagaaaaaaaagagcttctccacttttgggaaggactcccctagcgacgaggattcgggagactctagcacatcatctctgctatcagaaatgagcagtgtgttccagcgccttctccccgcatccctagataccttttctgaatgcaacgaaggggatcgctccaactctctggaacgtcgaaagggtccggcacagggcaaaactgggggttacccacaaggggttgcggcctgggcagccagcacacattttcagaaccccaccaacagctctgggacccctctggggactcactctagtgtgcagccttcctccaagtggctgccagctatggaggagattcctgaaaattacgaggaagatgattttgacaatgtgcttaaccatctcagtgatgggaaacacgaactcatggatgccagcgagctggtggctgagatcaacaaactgcttcaagacgtccgccagagctaggcgactttagctgggccgttgtggttccatgcgtgtggaattaggggacaggggaaaccccgaggaaaaaaactggcgttgccaaatagttgcatttatcataaatgtgtctgtgtatattgaatattaaatactgtattttcgtatgtacacgatgcaagtgtgattattttaatctgtattttaaaaatacatttgtaccttatatttatgtgtaatttaacagacaaattttatttttttactcccatgaccaacatgtttttcctaatcatgcagaaattagccactgtttgaatctatatccttttcaaccaaagttactgcttagcatagttaagtaggggcagaattattaagctgtataaacaacaccactaatgcattgtgtaattcttagtttcattaaacgaggctacttccttttcaatctttacaaaaaaaaatatattaagcattgttagaaacattaaacaatctttcgattactattttcactgctctctgttaactatgatagatcacttcttaaggcaaaatggaggacggaagtagacctattttgtacctagaagcatcccgaggtgttcccgggaaggcagtggtacgcgaattcttcatggtagtgatgctctagtccatgttgcctcgcagtggctcccgtactttttggtgcacggcactggcttgatcatgagaatactttttttttttccagtcgcaaaatatctacttataaacgaaactaaacggtgaatctgatttgatccttgccctatgaaataaaatccaatgatgtggaatctgtaatctaaatgaataacattaagtcccctaccagcacggagtgttgatagacagagacagatatgtcagtgctctgcccctccggggtagtaaacataatggatgtatctggaactctgtgtgcacctccccctcttctctcatcatacttgaacatttgtatcgactgcattgtctctcttttttttttttggctataattattcccctttagcttttgtctcttgtgcatgctatcacagttttgcttgtatttttagcatatgaacatttataaagtcacttttttttgttactgcaattttgtctgatttatcctgtgacaaatgcgaactttatttattgtgctgttatctcctatgtggaatgccttggtaagtgagatctttactatgactattatcatttatgtccacgcttctatgaatgttatttctattaatacactatcttgattgtactgttcagaaaaatttactgtcagtga

SEQ ID NO: 168 - DNA, 5145 bp, Mus musculus
ctttgtctgagttgaagtgaagttgtagagattttcagactggagtcagcaatcaccggtgtttagtctgcagcggagcagagaaaaggaaaggggggaaaatcaagaatcgcccgggaaacacagactgcagactccgccagcaccctgcaatagatggggacggagtccacgcggggagccaggccgaggtgacacgctgctcccagccaggaggaccagcggccacccctaccaggaagggacttcacgctcctatctggaagtcgccaaacggtgtgtatgaaaactgaagtttgcgagctgtttaattgctgtgtgattaagagtcgctttcaagactctgagacccgatgtggcttagagctctgagtggctgggaggaagttgaagggattgctgggctcttctaactcgccctgagaagggaatctagcaactgaccaatgcaccaaatgaatactaaaatgcactttagatttgcacttgcacttctgatggcgtttttcagccacgatgtcctggctaagaatctgaaatacaggatttatgaggagcagagggtcggatcggtaattgctagactatcagaagatgtggctgatgttttattgaagctaccaaatccttctgctgttcgttttcgagccatgccacgggggaattctcctctcctggtcgtaaatgagaataccggagaaatcagcataggggctaaaattgaccgcgagcaactatgccaaaaaaacttgaactgttcgatagagtttgatgtgctcactctgccgaccgagcatctgcagctgttccacattgaagtggacgtgctggacattaatgacaattccccccaattctcgagacccgtcattcccattgagatatcggagagcgcagcagttgggactcgtatccccctggacagtgcgttcgacccagatgttggggaaaattccctccacacctactcgctctctgctaatgattattttaatatcgaagtgcgaaccaggacagacggggccaagtacgctgaactcatagtggtgaaagagttggatcgggagctgaaggctagctacgagcttcagctcacggcctccgacatgggagtgcctcagaggtctggctcctccatcctgaaaatcagcatttcggattccaacgacaacagcccggcctttgagcagccttcttacacaatacaactcttagaaaactccccagttggaaccttgctccttgatctaaatgccaccgatccagatgagggcgctaatgggagaattgtgtattctttcagcagtcatgtgtctcccaaaattatagagacttttaagatcgactcagaaaaaggccacttgactcttttcaagccagtggattatgaaatcaccaagtcctatgagatagacgttcaagcccaagatttgggtcccaattccattcctgctcattgcaaaattataattaaggttgtggatgtcaatgacaataaacctgaaattagcataaatctcatgtcccctggaaaagaagaagtatcttatgtctttgaaggggatcccattgatacattcgttgctatcgtcagggttcaagacaaggattctgggctgaatggggaaataatctgtaagcttcatgggcatggacattttaaacttcagaagacatatgaaaataactacttgatcttgaccaatgccactctggatagagaaaagagatctgagtatagtttgactgtgattgctgaggacaagggaacaccaagcctctcctcagtgagacattttactgttcaaatcaatgacataaatgacaatccacctcgcttccagaggagccgatatgaatttgtcatctcagagaataattcaccaggggcgtatatcaccacagttacagccactgatccagatcttggtgaaaacggacatgtgacatacaccattttggagagttttgtcttgggaagttccatcaccacgtatgtaaccattgacccctctaatggcgccatctatgccctcaggatctttgatcatgaagaagtgagtcagatcacttttgtggtggaagccagggatggagggagtcagaagcaactctccagcaacaccaccgttgtgctgaccatcattgatgagaatgacaatgtccctgtggttatagggcctgcaatgcacaataatactgcagaaatatccatccccaaaggagctgaaagtggttttcatgtcacaagaataagggtggtcgacagggactctggtgccaatgctgaattcagctgctccatagtatctggtaatgaggaaaacatctttatcatggaccctaggtcatgtgacattcataccaacgtcagcatggaatccattccctctgcggaatgggcactctcagttatcatccaggacaagggcagtcctcctctgcacaccaaagtccttctgaggtgcatggtctttgactatgcagaatctgtgacaagcacagccatgacctctgtcagccgcgcatccttggatgtgtccatgatcataattatttccttgggagcaatttgtgctgtgttgctggttattatggtcctgtttgcaacgaggtgtaatagagaaaagaaagacaccagatcctacaactgcagggtggcagaatccacgtaccagcatcatcctaaaaggccatccaggcagattcacaaaggagacatcacactggtacccaccatcaatggcactctgcccatcagatctcaccacagatcctccccatcttcatccccaaccttggagaggggacaaatgggcagccgccagagtcacaacagtcaccagtcactcaacagtttggtgaccatctcatcaaaccacgtgccagagaatttttcattagaactcacccacgccactcctgctgttgaggtctcgcagcttctctccatgcttcaccaggggcaatatcagccacggccaagttttcgaggaaacaaatattccaggagctatagatatgcccttcaagacatggataaatttagcctgaaagacagtggccgtggagatagcgaagcaggagatagtgattatgatttggggcgcgattctccgatagacaggctcctgggagaaggattcagtgacctcttcctcacggacgggagaattccagcagcaatgaggctatgtacggaggagtgcagagtcctgggccactctgaccagtgctggatgcccccgctgccctcgccatcctctgactacagaagcaacatgttcatccccggagaagaattcccagctcaacctcagcaacagcattctcatcagggccttgatgatgacagccagcctgcagaaaacggggagaaaaaaaagagcttctccacttttgggaaggactcccctagcgacgaggattcgggagactctagcacatcatctctgctatcagaaatgagcagtgtgttccagcgccttctccccgcatccctagataccttttctgaatgcaacgaaggggatcgctccaactctctggaacgtcgaaagggtccggcacagggcaaaactgggggttacccacaaggggttgcggcctgggcagccagcacacattttcagaaccccaccaacagctctgggacccctctggggactcactctagtgtgcagccttcctccaagtggctgccagctatggaggagattcctgaaaattacgaggaagatgattttgacaatgtgcttaaccatctcagtgatgggaaacacgaactcatggatgccagcgagctggtggctgagatcaacaaactgcttcaagacgtccgccagagctaggcgactttagctgggccgttgtggttccatgcgtgtggaattaggggacaggggaaaccccgaggaaaaaaactggcgttgccaaatagttgcatttatcataaatgtgtctgtgtatattgaatattaaatactgtattttcgtatgtacacgatgcaagtgtgattattttaatctgtattttaaaaatacatttgtaccttatatttatgtgtaatttaacagacaaattttatttttttactcccatgaccaacatgtttttcctaatcatgcagaaattagccactgtttgaatctatatccttttcaaccaaagttactgcttagcatagttaagtaggggcagaattattaagctgtataaacaacaccactaatgcattgtgtaattcttagtttcattaaacgaggctacttccttttcaatctttacaaaaaaaaatatattaagcattgttagaaacattaaacaatctttcgattactattttcactgctctctgttaactatgatagatcacttcttaaggcaaaatggaggacggaagtagacctattttgtacctagaagcatcccgaggtgttcccgggaaggcagtggtacgcgaattcttcatggtagtgatgctctagtccatgttgcctcgcagtggctcccgtactttttggtgcacggcactggcttgatcatgagaatactttttttttttccagtcgcaaaatatctacttataaacgaaactaaacggtgaatctgatttgatccttgccctatgaaataaaatccaatgatgtggaatctgtaatctaaatgaataacattaagtcccctaccagcacggagtgttgatagacagagacagatatgtcagtgctctgcccctccggggtagtaaacataatggatgtatctggaactctgtgtgcacctccccctcttctctcatcatacttgaacatttgtatcgactgcattgtctctcttttttttttttggctataattattcccctttagcttttgtctcttgtgcatgctatcacagttttgcttgtatttttagcatatgaacatttataaagtcacttttttttgttactgcaattttgtctgatttatcctgtgacaaatgcgaactttatttattgtgctgttatctcctatgtggaatgccttggtaagtgagatctttactatgactattatcatttatgtccacgcttctatgaatgttatttctattaatacactatcttgattgtactgttcagaaaaatttactgtcagtga

SEQ ID NO: 169 - protein, 1134 aa, Mus musculus
MHQMNTKMHFRFALALLMAFFSHDVLAKNLKYRIYEEQRVGSVIARLSEDVADVLLKLPNPSAVRFRAMPRGNSPLLVVNENTGEISIGAKIDREQLCQKNLNCSIEFDVLTLPTEHLQLFHIEVDVLDINDNSPQFSRPVIPIEISESAAVGTRIPLDSAFDPDVGENSLHTYSLSANDYFNIEVRTRTDGAKYAELIVVKELDRELKASYELQLTASDMGVPQRSGSSILKISISDSNDNSPAFEQPSYTIQLLENSPVGTLLLDLNATDPDEGANGRIVYSFSSHVSPKIIETFKIDSEKGHLTLFKPVDYEITKSYEIDVQAQDLGPNSIPAHCKIIIKVVDVNDNKPEISINLMSPGKEEVSYVFEGDPIDTFVAIVRVQDKDSGLNGEIICKLHGHGHFKLQKTYENNYLILTNATLDREKRSEYSLTVIAEDKGTPSLSSVRHFTVQINDINDNPPRFQRSRYEFVISENNSPGAYITTVTATDPDLGENGHVTYTILESFVLGSSITTYVTIDPSNGAIYALRIFDHEEVSQITFVVEARDGGSQKQLSSNTTVVLTIIDENDNVPVVIGPAMHNNTAEISIPKGAESGFHVTRIRVVDRDSGANAEFSCSIVSGNEENIFIMDPRSCDIHTNVSMESIPSAEWALSVIIQDKGSPPLHTKVLLRCMVFDYAESVTSTAMTSVSRASLDVSMIIIISLGAICAVLLVIMVLFATRCNREKKDTRSYNCRVAESTYQHHPKRPSRQIHKGDITLVPTINGTLPIRSHHRSSPSSSPTLERGQMGSRQSHNSHQSLNSLVTISSNHVPENFSLELTHATPAVEVSQLLSMLHQGQYQPRPSFRGNKYSRSYRYALQDMDKFSLKDSGRGDSEAGDSDYDLGRDSPIDRLLGEGFSDLFLTDGRIPAAMRLCTEECRVLGHSDQCWMPPLPSPSSDYRSNMFIPGEEFPAQPQQQHSHQGLDDDSQPAENGEKKKSFSTFGKDSPSDEDSGDSSTSSLLSEMSSVFQRLLPASLDTFSECNEGDRSNSLERRKGPAQGKTGGYPQGVAAWAASTHFQNPTNSSGTPLGTHSSVQPSSKWLPAMEEIPENYEEDDFDNVLNHLSDGKHELMDASELVAEINKLLQDVRQS

SEQ ID NO: 170 - DNA, 13564 bp, Homo sapiens
  misc_feature (1)  (13564): n = A, C, G, or T/U
tgagttgaagtgaagttgtacagattttagactggagtcagcaatcacgggtgtttagtctgcagccgagcagctaaagggagaaagaatcgctcaggaaagacacactgcagactccaccggcaccctgcaatagatggattccgactacacaagggagaaaacgcggaggtgacactctcctgcctggaaagaggacgaacgaccaaacaaacgcaaggactggactccatgccgaaggtatctggaagtcgtgacacggtgtgtataaaacaaaagtttgcgagctgttaattgctgtgctgtgttattaagagacgctttcaagtttcaagtaccaaatgtagctttacgttgccaaaggaagttgaggcaattgctttgctgttttaacttgctctgtgagggaaatctcataaactgaccaatgcaccaaatgaatgctaaaatgcactttaggtttgtttttgcacttctgatagtatctttcaaccacgatgtactgggcaagaatttgaaatacaggatttatgaggaacagagggttggatcagtaattgcaagactatcagaggatgtggctgatgttttattgaagcttcctaatccttctactgttcgatttcgagccatgcagaggggaaattctcctctacttgtagtaaacgaggataatggggaaatcagcataggggctacaattgaccgtgaacaactgtgccagaaaaacttgaactgttccatagagtttgatgtgatcactctacccacagagcatctgcagcttttccatattgaagttgaagtgctggatattaatgacaattctccccagttttcaagatctctcatacctattgagatatctgagagtgcagcagttgggactcgcattcccctggacagtgcatttgatccagatgttggggaaaattccctccacacatactcgctctctgccaatgatttttttaatatcgaggttcggaccaggactgatggagccaagtatgcagaactcatagtggtcagagagttagatcgggagctgaagtcaagctacgagcttcagctcactgcctcagacatgggagtacctcagaggtctggctcatccatactaaaaataagcatttcagactccaatgacaacagccctgcttttgagcagcaatcttatataatacaactcttagaaaactccccggttggcactttgctcttagatctgaatgccacggatccagatgagggcgctaatgggaaaattgtatattccttcagcagtcatgtgtctcccaaaattatggagacttttaaaattgattctgaaagaggacatttgactcttttcaagcaagtggattatgaaatcaccaaatcctatgagattgatgttcaggctcaagatttgggtccaaattcaatcccagcccattgcaaaattataattaaggttgtggatgttaatgacaataaacctgaaattaacatcaacctcatgtcccctggaaaagaagaaatatcttatatttttgaaggggatcctattgatacatttgttgctttggtcagagttcaggacaaggattctgggctgaatggagaaatagtttgtaagcttcatggacatggtcactttaaacttcagaagacatatgaaaacaattatttaatcttaactaatgccacactggatagagaaaagagatctgagtatagtttgactgtaatcgctgaggacagggggacacccagtctctctacagtgaaacattttacagttcaaatcaatgatatcaatgacaatccaccccacttccagagaagccgatatgaatttgtaatttcagaaaataactcaccaggggcatatatcaccactgttacagccacagatcctgatcttggagaaaatgggcaagtgacatacaccatcttggagagttttattctaggaagttccataactacatatgtaaccattgacccatctaatggagccatctatgccctcagaatctttgatcatgaagaagtgagtcagatcacttttgtggtagaagcaagagatggaggaagcccgaagcaactggtaagcaataccacagttgtgctcaccatcattgacgaaaatgacaacgttcctgtggttatagggcctgcattgcgtaataatacggcagaaatcaccattcccaaaggggctgaaagtggctttcatgtcacaagaataagggcaattgacagagactctggtgtgaatgctgaactcagctgcgccatagtagcaggtaatgaggagaatatcttcataattgatccacgatcatgtgacatccataccaacgttagcatggattctgttccctacacagaatgggagctgtcagttatcattcaggacaaaggcaatcctcagctacataccaaagtccttctgaagtgcatgatctttgaatatgcagagtcggtgacaagtacagcaatgacttcagtaagccaggcatccttggatgtctccatgataataattatttccttaggagcaatttgtgcagtgttgctggttattatggtgctatttgcaactaggtgtaaccgcgagaagaaagacactagatcctataactgcagggtggccgaatcaacttaccagcaccacccaaaaaggccatcccggcagattcacaaaggggacatcacattggtgcctaccataaatggcactctgcccatcagatctcatcacagatcgtctccatcttcatctcctaccttagaaagagggcagatgggcagccggcagagtcacaacagtcaccagtcactcaacagtttggtgacaatctcatcaaaccacgtgccagagaatttctcattagaactcacccacgccactcctgctgttgaggtaagatcataaaccgcatcaattcattgcaatgttaggtgttagtgttcaggaattgtgtttactagttcttaaatgttttcattaataagtaacaatactaatactgtgcaaattaagtaggatacaagttacattgtgaatatgtagcaaagatgcacactttagcatactgtttttagttttccttaagtaaataacttcatataatatgtgtaatattgaaaaataaatgtgaaggtcacaaaggactatgtaattagagtccccttgcttcccagattaaaataatgggaagccaaaaagtagagacttgctttattttcaaggttatagtctttactgaacaaataaaaaaactgaggccttcagacttctatttcaatgcatgctatgtttgtccaagtttggaagatttcctgacattttttaaactacatgcattgcagtgttgtattttacagtattttccatgtatttttacaggtggtcactttgtctgaattataaagaaaataaatcagttatttgaaagggagtcttctttcacaaagtaaaagtcagttgtattaggtcatccaaatctctctgagatatattttagttatagttggtagctggctgcgtggtccgccacagtccagcatttgcaaatcttttaaatagagagaatatattcaattacttagttgaaatagcaagcaactgtttttcttgcttaaagattgtgagtgtttggaggcttgtttccgggaatcagttctgtctatttggtttccagcaggtctctcagcttctttcaatgcttcaccaggggcaatatcagccaagaccaagttttcgaggaaacaaatattccaggagctacaggtatgaattattcttgtgttacctattaagtttcaacataaatgctgaagagtaaaaactgtaatttttttttctgatttatctttccagatatgcccttcaagacatggacaaatttagcttgaaagacagtggccgtggtgacagtgaggcaggagacagtgattatgatttggggcgagattctccaatagataggctgctgggtgaaggattcagcgacctgtttctcacagatggaagaattccagcaggtaagagggtagtgatagaaaatctttattttcaggtctaccgtgacaccagtaaaatgaaaaatttctctcatgcttatatttcttctttatttgtcccttgcactaaagtatttataatatgttttatagtatgttcatcactgtttagtaatgaacagaaactgaaacattttaacactgttttcttaaatttcattaagcggttggaagagaacgagtaagcatgacagcttcataggacaagaagaaaggggtggggaaaaatcaaaaaaacaaacactttccccctctttccacctcatccgatacagccatagaacacggttgtgtaactctttgcaaaattattgggtggtggtttttattcagttaaactgttttggcgcagagtggtgaaccggactgtaatttggaggatgcatttcctgtgatgggcaccaactcacaaaatcagagactaaaatacactggaaattgtacacttcaagcattaaaaataggagaaggaatgcatctttgtaggtggtaagcacagaatatttttgccaacatttcattttgctatagtagaagaggcacagggacccaagagtggaatttttaagtacacagctagatagaagagatgctattaagtttcgaaccacgttttccttggagttccttccctctaattctgcaataggaactctctgaactgactaaatactgattatattatcctagcagccccactactaaagactgcaatattaaatcaaccttaggaatacgtgtgttcttttggctacctatatttccaagtttcactgaatgtgactgccatttgatatatgaaagatagaacaacacaatatcacccatcttagtttcatcgcacctctatttttgaatacagataagtaagagagtttaggaaataaacatgagggagcctcagacagctacaggaattcaagaaaatcaatatagctgacattccgtatcagcaggttccacatccatagattcaaccaactgttaattgaaagtatttggattaaacaataaaaaatagcaatacaacaataaaaaacaatacaaataaaaaacaatacagtataacaactatttacatagcatttacatttattaggtatttttannnnnnnnnnnnnnnnnnnnnnnnnnnnccactttatataagcaacccaattttgatatccacagggggcctggaccaatcccctttggataccaaaggaccactgtgaatagaaactcgagcactcataagtgaagtagtgatggcagtagccagagcggtattaatattaggaatagtagtagcaatagtagttaccaactatgcccccaggtttactccaggctcatgcagagtttgatacctgcactgcctctcctaaggctttggcaggaattagtagtagtgacagtagtaacaggcttctattttttttttttttttttttttaagatttggaaactgaaagttataaaggttagaaaatgcatctcaaatcaggcagtttgtacatgggagagtgagatttggaccaatccctgcactcttaaacactaatctatcaagtatgtgaagtaacaggtttttgttgttgtagtaattgtttttaagtagagtgtcctcattgttcttatgttctaaagacttatgacataccccataactattaaatgttgattatttaattctgttatcacagtaatagatgctataatatatctcacaggatgaacgtatgggggggacttcgagagacaataaggcatgccgtgtacctgagagcctgtttgcacagtcatggtgtctgttttttgtttttgtttttaatgcatagactttcttgaccaatttgaagagaaatctctgaaaatttagtggaatatatttagaatcagacactttgctcaaagagaatcagttttcttattcgtacttgtgtaataaaggagttggctaaactacaattctgtgatcctgacagaaccctaattttgagtattaatccttgattttaaataatgtaatttcatttcattaaacagaaaagtaacatagtgggcatgacatcaatattgtattatatatttttagatttgtataatgtttattcattgaaatttaaatttatcagcatacttaactgaatagctgctctaattacataaccttggtattttggggattaaatgatcctaaagtcccttttaattctgaaattgtagaaatctaatagctaattataaagttttttttaggtcaaagttcttttactttttcttatattttctaagttgccacctccacgtaagtttgtggcaagaaagttttctagcacttggagtaaataataataataataattacaataataataatagatgttaaggaataaagacactggcgaaacaataggtagacatagataaactgtagaaaactgaattgtgtttagtgagtgacgttaagcttcatcagtatcacatttcttttcaaaattaggagttcacctttatatcatcattaataattccacttaacatgagacaattttttaaaaaaaatctcatatttgcacaatcacacttaaccatgggtgtggctggagagttattttgcttgtgcataacattgtgttacaacaaaatacattatagtagatacaattctgccttactaggtacctgcctccatctgaggtgtggtcaaagctatcctggaggtatcgagcaccaggaagtcaccaatggtccgcaaagtatattcatgtttggctactgtagactgcaatatgcatactgtgtatctatacaaagataactatcccttatttatgagtataattttgatgacacatattccaatttattatttaccccagcaacttctggaggcataatagggtgtaaaacttgtgttttgtaaatttatattcccagaaaatatcccaagtagagaaaaatgtaagtccacatctgaatgccattaaaagagatcagcacagtttccatagcatttatatttctaggactaaagtgtcttgttccaactgtttttctgccttagactttgaacaaatatagattatgttatgttgcattgcctgccaacagggtcatttctggtcattcatgctattaattcccacacaaatatcctgcattttgagcagtcaaattggtatgcatttttttgtctgttggctcatgtttgccaacatactttcttactcattcaactttgaactataacactaagcatatgcctgcaaaaatccccattttccattgcattcacttcaccaggatgatttatacagccgtttgattttgtttcttgtgacgctcatttttcttgattgagtccaatccacttttcatcagtctgtcgtctctgattacttactttaaatattctttttaaattctatgttctctcctttctcatggcaggtatccacgaaagcccatctgttctggcctttcttccatgacaggtttagtgtgtcagtgtgcaaactgatattcactgtctagtagctcctccctttgtcaaatctttctttcatacagcttgaacaacattttgagaacattttaatccacattttttggctcaaaatcaatacttaactcttgttgcccagcaacattgaactaaactatttatcttggcattcaaagggcaatggaatcccctcttagcttattaactctcatatgttgccatctttgtatcttttgttatagctagaagcatctcctcacttaatacactgatgctttgctcatggtgtccttcctacctgaaaagctggcttctcatcactttgtgtaactgaatcctattcatctttcaaagtttgttttaggtggctctttctttaactatttcagcttccacctccactcttttttcctttcttgacatgcccttagcatcatctagtttgacactttacctgtgtttacgatgtcacttgctacactttacttagagctatatctttttacaacttttgagggcagggtgctattgttgcacttcacatgcagcagactcataacggataactgattgatcacctgatgacttgacagaagcaaggcatacgtatttcttcttatatatctgctgcctgtcccaccaataaggtgcagtgcagtgacaaaattcatagtcttatagtggtgaagaagatactctcctttcaccatggtccccctccccagaggacacttaactacctataagagctttcaaggagcaacagaaagattagccacttgcaccacttgtcaacaagccctgctaactgggatatagtatggaacatttgcggcactgaattacttacagattgagaatgttttcagtccaagtccctggggacaaggttgacaatatcaatgaggttgcaaagaaatgccttcttctgcaccgttactcttccatttctcttatttttgccatccttccctccattagtcttttctcatcaatttttcttattacttttcatttttaagttaatttattattttataattaaagcttcacttatttattgggatgaagttgcaaataacattcactgtttaaaaaatttctatgaccaaacttatttttgagcatgaactttcagattgcattagttacctagattgtatttttgcattgtattgttggttatatgtttattatatttaggtctttagaaaactaggtcattttcagtattcttacaagcctttcctttccctccaatcattaagcattaaactaaagtgaatcaaacaactaagtccttcccaagcctaaaactacagagttaaatgaaataaatgaagaggtgtcagcaggtctgttcttcttccttctgacaggatatgagtaagacaatagagacaggtctaagttccattttcagagacctgcggaattaagaaggaaaaaaaaaatcattaccactatgattgttattttgctgctgagaaaacctcattgctattaagttattccaattactttcaaccccttttgtttcatccacatcaaattaaaaaaaaaaaagttggtaaacatttccaagtagtaatactgcatgaagtcaggaaatctaaaaaagcttttattcttaaatcattcttgcttatttaaatgtaacctttcataacaaattgcacaatttttcttcatgcttaccctctttctctttccccaccttgattcacatggaattggtgttgacactttctccactttttttctgcttcattgtatttctagttttctagtgattcagcttttttctcactcataatacttgatctcattttattcctcaaattatcctccttttcattaaaacttgaggtccatatttgggactcttgcagtttaagaacagaattatctcaaagattcaagcagagaaaagcagcaatttctacgccttcaatcaaagaccattacttcttttttttcagaaagtcaacattattttctccatgttttatttagaaaacatgtagtgaatacctactgtatgcaggcactttaccagttgctagtgacaccgcagtaactgcaatagacaacttgtttcctctaataagggaatgggcatccttcaagagtcacctttttagcaataatttgggaggaagaggaatcttcctaaagtagatggatctacaaaattagctcttaatatataagtatagctagtaacaacctaatgttcttttaaatctaagagaattattttgcattttctgcattctgctctttgctctaaaatgaaatcataatactgaacagccttatttctcactgaaataagtcaatggtttgtagagtgtattttacatcttttcatttccttgtcatgcagcttagttattgtatttgccaaatgtagaggggttttttcctctttattttcctgcttttctcatatcatctattttttttcctatgactgtggccactcatattcccataagagcattagaacatctgtaagacctaaggaatggatttttcatattcttcatcttttgatgacatttttcacatatttgaatataaatatattttgaatctttaaaagaaaacttcttaacagggtaattgcagatggccatccagtagctgaggatacttttcactgctgtgttaagtaacaagtcaataaataatttgtaatatctttaagagagattaataagtataattaccttatagcttattatattctcattgcttccattaaaactaaagtaatattgagaaagttacacaaaggtatgtattacacaagaattaatgggtggcattctaaagttataggtttcaccttacaagtctgttctttagaatttatgttcagcacttatttcatcactcacacctagttcttcccacgtatactttatcaacccatcttatcattattcaagtagcagaatattcttacctgatcaataaggaaaaaaaagcacaccagaagataacacttatggaggtctataaaaccagtgttcaaattaaagccataattgtagtccagcttttgtgtataataataggttggcatcatggaaatagtttaaaattgtctcattctatttttattataaaattgcatttttgcatcattttgaatcgtgctaagtataataatgaatccccactgtttttcttgagtgcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatgggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaagcatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaatgcaagtgtgattattttaatctgtattttaaaaatacatttgtaccttatatttatgtgtaatttaacaaacaaattttatttttttactcccatgacagacatgtttttcctagtcgtgtagaaactagccactgttcaaatctgatacactattcaaccacaaagtgtaaaggcactgcttagattagttttgttggggaagaattattatgttgtatgaacaaccccactgaagcattatacaattcttaattccattaagtgatcccactttttttcaataactttttagaaattaagaatcattaaaattgttaagctattttattgttattttctctactttctactagccccaatagttgaactcttataggaaaatcgaaagataaagtgaaagtttatttcaggactgagaaatatcttgaaggttatttattagatgactatctcaaatgaactttttatagacaatgatgaaaacagaactaaagtcaatgtttcctgactcccaggcccctactattccaggccatcacactggcctgttccggagaatatttctctcacaatattattatctacttataattatggtaaacaataaattttattccatccttgtagtatgaaacatgctccaaggaaatggaatctgtcctttaaatggataacagtatgtgttctaatggcataaaatattactggataaaaacagttgtgtcagtgtctctcctaaggtagtaaatataattgacttattctgaacccattctattttgaatctcccctttcctctcacaatacttgaacattttaatcttttggaatattgtctttctttgttataactattcatttttagcttttgtctccagtgcatgatctcatatttttgcttttatttttagtataagaacatttataaaatcatatttttgttactgcaattgttttatttgttgtgtggcaaatgagaaatcctttatttattgtgctgtgatctctctgtgtggaatgccttggtgagagagatgcttattatgactattatcatttctgaccaagcttctattaatgttatttctaataatacactatcttgattgtactctccagaaaatttttctgtcagtgaaaataaaagaaaaattaaagtaaagctaaggaactgtctataagtcagagtcctgttcctacatatttgttcaaaagcttggcatgcagcaggcccttcctgagctggtgattcagtgttgagtttcaaataataaacaggcagcattcagttggctgggcgaacaagaaaaacacaatggaaaaggaatgagtttgagacttgtaatgggaatgaaagtagtaagccatattccagctaaataagttaaatgcatttggggaataaagaaaaaagagtaagcaagcaataattgcttgaatatttttcaaattacaacaaaaaaaaatactttcttaggacattttgtattaaattgtgcaggataaaaaggtatccttacaatgtttccaggaggcaagaatattatcgtccctggcttgctagtcaggaattgaaacactgggaaagttaagtaactgaaaagtgactaaaattcagatatttgaattctcaaatgagtaccacattaaatagaatatattacctctttcaacaggcacattttcctttataggagagattgcaattacaagtgaaatttcagtatatttttcagtagattacacacacaaacgctaaccatatttaaatgcattctgcctttcaacttcacttcctttcagtatatattaccattaagaaaaagacttttatatcctcactgttcttaatttaaagcaccagcagtaatatgggaagctatgctgaaaaccgctattttgaataatgtgaaataaataaaatgcaatatttcattcaacacaaaactttt

SEQ ID NO: 171 - DNA, 5952 bp, Homo sapiens
tgagttgaagtgaagttgtacagattttagactggagtcagcaatcacgggtgtttagtctgcagccgagcagctaaagggagaaagaatcgctcaggaaagacacactgcagactccaccggcaccctgcaatagatggattccgactacacaagggagaaaacgcggaggtgacactctcctgcctggaaagaggacgaacgaccaaacaaacgcaaggactggactccatgccgaaggtatctggaagtcgtgacacggtgtgtataaaacaaaagtttgcgagctgttaattgctgtgctgtgttattaagagacgctttcaagtttcaagtaccaaatgtagctttacgttgccaaaggaagttgaggcaattgctttgctgttttaacttgctctgtgagggaaatctcataaactgaccaatgcaccaaatgaatgctaaaatgcactttaggtttgtttttgcacttctgatagtatctttcaaccacgatgtactgggcaagaatttgaaatacaggatttatgaggaacagagggttggatcagtaattgcaagactatcagaggatgtggctgatgttttattgaagcttcctaatccttctactgttcgatttcgagccatgcagaggggaaattctcctctacttgtagtaaacgaggataatggggaaatcagcataggggctacaattgaccgtgaacaactgtgccagaaaaacttgaactgttccatagagtttgatgtgatcactctacccacagagcatctgcagcttttccatattgaagttgaagtgctggatattaatgacaattctccccagttttcaagatctctcatacctattgagatatctgagagtgcagcagttgggactcgcattcccctggacagtgcatttgatccagatgttggggaaaattccctccacacatactcgctctctgccaatgatttttttaatatcgaggttcggaccaggactgatggagccaagtatgcagaactcatagtggtcagagagttagatcgggagctgaagtcaagctacgagcttcagctcactgcctcagacatgggagtacctcagaggtctggctcatccatactaaaaataagcatttcagactccaatgacaacagccctgcttttgagcagcaatcttatataatacaactcttagaaaactccccggttggcactttgctcttagatctgaatgccacggatccagatgagggcgctaatgggaaaattgtatattccttcagcagtcatgtgtctcccaaaattatggagacttttaaaattgattctgaaagaggacatttgactcttttcaagcaagtggattatgaaatcaccaaatcctatgagattgatgttcaggctcaagatttgggtccaaattcaatcccagcccattgcaaaattataattaaggttgtggatgttaatgacaataaacctgaaattaacatcaacctcatgtcccctggaaaagaagaaatatcttatatttttgaaggggatcctattgatacatttgttgctttggtcagagttcaggacaaggattctgggctgaatggagaaatagtttgtaagcttcatggacatggtcactttaaacttcagaagacatatgaaaacaattatttaatcttaactaatgccacactggatagagaaaagagatctgagtatagtttgactgtaatcgctgaggacagggggacacccagtctctctacagtgaaacattttacagttcaaatcaatgatatcaatgacaatccaccccacttccagagaagccgatatgaatttgtaatttcagaaaataactcaccaggggcatatatcaccactgttacagccacagatcctgatcttggagaaaatgggcaagtgacatacaccatcttggagagttttattctaggaagttccataactacatatgtaaccattgacccatctaatggagccatctatgccctcagaatctttgatcatgaagaagtgagtcagatcacttttgtggtagaagcaagagatggaggaagcccgaagcaactggtaagcaataccacagttgtgctcaccatcattgacgaaaatgacaacgttcctgtggttatagggcctgcattgcgtaataatacggcagaaatcaccattcccaaaggggctgaaagtggctttcatgtcacaagaataagggcaattgacagagactctggtgtgaatgctgaactcagctgcgccatagtagcaggtaatgaggagaatatcttcataattgatccacgatcatgtgacatccataccaacgttagcatggattctgttccctacacagaatgggagctgtcagttatcattcaggacaaaggcaatcctcagctacataccaaagtccttctgaagtgcatgatctttgaatatgcagagtcggtgacaagtacagcaatgacttcagtaagccaggcatccttggatgtctccatgataataattatttccttaggagcaatttgtgcagtgttgctggttattatggtgctatttgcaactaggtgtaaccgcgagaagaaagacactagatcctataactgcagggtggccgaatcaacttaccagcaccacccaaaaaggccatcccggcagattcacaaaggggacatcacattggtgcctaccataaatggcactctgcccatcagatctcatcacagatcgtctccatcttcatctcctaccttagaaagagggcagatgggcagccggcagagtcacaacagtcaccagtcactcaacagtttggtgacaatctcatcaaaccacgtgccagagaatttctcattagaactcacccacgccactcctgctgttgagcaggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgctgggtgaaggattcagcgacctgtttctcacagatggaagaattccagcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatgggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaagcatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaatgcaagtgtgattattttaatctgtattttaaaaatacatttgtaccttatatttatgtgtaatttaacaaacaaattttatttttttactcccatgacagacatgtttttcctagtcgtgtagaaactagccactgttcaaatctgatacactattcaaccacaaagtgtaaaggcactgcttagattagttttgttggggaagaattattatgttgtatgaacaaccccactgaagcattatacaattcttaattccattaagtgatcccactttttttcaataactttttagaaattaagaatcattaaaattgttaagctattttattgttattttctctactttctactagccccaatagttgaactcttataggaaaatcgaaagataaagtgaaagtttatttcaggactgagaaatatcttgaaggttatttattagatgactatctcaaatgaactttttatagacaatgatgaaaacagaactaaagtcaatgtttcctgactcccaggcccctactattccaggccatcacactggcctgttccggagaatatttctctcacaatattattatctacttataattatggtaaacaataaattttattccatccttgtagtatgaaacatgctccaaggaaatggaatctgtcctttaaatggataacagtatgtgttctaatggcataaaatattactggataaaaacagttgtgtcagtgtctctcctaaggtagtaaatataattgacttattctgaacccattctattttgaatctcccctttcctctcacaatacttgaacattttaatcttttggaatattgtctttctttgttataactattcatttttagcttttgtctccagtgcatgatctcatatttttgcttttatttttagtataagaacatttataaaatcatatttttgttactgcaattgttttatttgttgtgtggcaaatgagaaatcctttatttattgtgctgtgatctctctgtgtggaatgccttggtgagagagatgcttattatgactattatcatttctgaccaagcttctattaatgttatttctaataatacactatcttgattgtactctccagaaaatttttctgtcagtgaaaataaaagaaaaattaaagtaaagctaaggaactgtctataagtcagagtcctgttcctacatatttgttcaaaagcttggcatgcagcaggcccttcctgagctggtgattcagtgttgagtttcaaataataaacaggcagcattcagttggctgggcgaacaagaaaaacacaatggaaaaggaatgagtttgagacttgtaatgggaatgaaagtagtaagccatattccagctaaataagttaaatgcatttggggaataaagaaaaaagagtaagcaagcaataattgcttgaatatttttcaaattacaacaaaaaaaaatactttcttaggacattttgtattaaattgtgcaggataaaaaggtatccttacaatgtttccaggaggcaagaatattatcgtccctggcttgctagtcaggaattgaaacactgggaaagttaagtaactgaaaagtgactaaaattcagatatttgaattctcaaatgagtaccacattaaatagaatatattacctctttcaacaggcacattttcctttataggagagattgcaattacaagtgaaatttcagtatatttttcagtagattacacacacaaacgctaaccatatttaaatgcattctgcctttcaacttcacttcctttcagtatatattaccattaagaaaaagacttttatatcctcactgttcttaatttaaagcaccagcagtaatatgggaagctatgctgaaaaccgctattttgaataatgtgaaataaataaaatgcaatatttcattcaacacaaaactttt

SEQ ID NO: 172 - protein, 1093 aa, Homo sapiens [sequence omitted]

SEQ ID NO: 173 - DNA, 5949 bp, Homo sapiens
tgagttgaagtgaagttgtacagattttagactggagtcagcaatcacgggtgtttagtctgcagccgagcagctaaagggagaaagaatcgctcaggaaagacacactgcagactccaccggcaccctgcaatagatggattccgactacacaagggagaaaacgcggaggtgacactctcctgcctggaaagaggacgaacgaccaaacaaacgcaaggactggactccatgccgaaggtatctggaagtcgtgacacggtgtgtataaaacaaaagtttgcgagctgttaattgctgtgctgtgttattaagagacgctttcaagtttcaagtaccaaatgtagctttacgttgccaaaggaagttgaggcaattgctttgctgttttaacttgctctgtgagggaaatctcataaactgaccaatgcaccaaatgaatgctaaaatgcactttaggtttgtttttgcacttctgatagtatctttcaaccacgatgtactgggcaagaatttgaaatacaggatttatgaggaacagagggttggatcagtaattgcaagactatcagaggatgtggctgatgttttattgaagcttcctaatccttctactgttcgatttcgagccatgcagaggggaaattctcctctacttgtagtaaacgaggataatggggaaatcagcataggggctacaattgaccgtgaacaactgtgccagaaaaacttgaactgttccatagagtttgatgtgatcactctacccacagagcatctgcagcttttccatattgaagttgaagtgctggatattaatgacaattctccccagttttcaagatctctcatacctattgagatatctgagagtgcagcagttgggactcgcattcccctggacagtgcatttgatccagatgttggggaaaattccctccacacatactcgctctctgccaatgatttttttaatatcgaggttcggaccaggactgatggagccaagtatgcagaactcatagtggtcagagagttagatcgggagctgaagtcaagctacgagcttcagctcactgcctcagacatgggagtacctcagaggtctggctcatccatactaaaaataagcatttcagactccaatgacaacagccctgcttttgagcagcaatcttatataatacaactcttagaaaactccccggttggcactttgctcttagatctgaatgccacggatccagatgagggcgctaatgggaaaattgtatattccttcagcagtcatgtgtctcccaaaattatggagacttttaaaattgattctgaaagaggacatttgactcttttcaagcaagtggattatgaaatcaccaaatcctatgagattgatgttcaggctcaagatttgggtccaaattcaatcccagcccattgcaaaattataattaaggttgtggatgttaatgacaataaacctgaaattaacatcaacctcatgtcccctggaaaagaagaaatatcttatatttttgaaggggatcctattgatacatttgttgctttggtcagagttcaggacaaggattctgggctgaatggagaaatagtttgtaagcttcatggacatggtcactttaaacttcagaagacatatgaaaacaattatttaatcttaactaatgccacactggatagagaaaagagatctgagtatagtttgactgtaatcgctgaggacagggggacacccagtctctctacagtgaaacattttacagttcaaatcaatgatatcaatgacaatccaccccacttccagagaagccgatatgaatttgtaatttcagaaaataactcaccaggggcatatatcaccactgttacagccacagatcctgatcttggagaaaatgggcaagtgacatacaccatcttggagagttttattctaggaagttccataactacatatgtaaccattgacccatctaatggagccatctatgccctcagaatctttgatcatgaagaagtgagtcagatcacttttgtggtagaagcaagagatggaggaagcccgaagcaactggtaagcaataccacagttgtgctcaccatcattgacgaaaatgacaacgttcctgtggttatagggcctgcattgcgtaataatacggcagaaatcaccattcccaaaggggctgaaagtggctttcatgtcacaagaataagggcaattgacagagactctggtgtgaatgctgaactcagctgcgccatagtagcaggtaatgaggagaatatcttcataattgatccacgatcatgtgacatccataccaacgttagcatggattctgttccctacacagaatgggagctgtcagttatcattcaggacaaaggcaatcctcagctacataccaaagtccttctgaagtgcatgatctttgaatatgcagagtcggtgacaagtacagcaatgacttcagtaagccaggcatccttggatgtctccatgataataattatttccttaggagcaatttgtgcagtgttgctggttattatggtgctatttgcaactaggtgtaaccgcgagaagaaagacactagatcctataactgcagggtggccgaatcaacttaccagcaccacccaaaaaggccatcccggcagattcacaaaggggacatcacattggtgcctaccataaatggcactctgcccatcagatctcatcacagatcgtctccatcttcatctcctaccttagaaagagggcagatgggcagccggcagagtcacaacagtcaccagtcactcaacagtttggtgacaatctcatcaaaccacgtgccagagaatttctcattagaactcacccacgccactcctgctgttgaggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgctgggtgaaggattcagcgacctgtttctcacagatggaagaattccagcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatgggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaagcatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaatgcaagtgtgattattttaatctgtattttaaaaatacatttgtaccttatatttatgtgtaatttaacaaacaaattttatttttttactcccatgacagacatgtttttcctagtcgtgtagaaactagccactgttcaaatctgatacactattcaaccacaaagtgtaaaggcactgcttagattagttttgttggggaagaattattatgttgtatgaacaaccccactgaagcattatacaattcttaattccattaagtgatcccactttttttcaataactttttagaaattaagaatcattaaaattgttaagctattttattgttattttctctactttctactagccccaatagttgaactcttataggaaaatcgaaagataaagtgaaagtttatttcaggactgagaaatatcttgaaggttatttattagatgactatctcaaatgaactttttatagacaatgatgaaaacagaactaaagtcaatgtttcctgactcccaggcccctactattccaggccatcacactggcctgttccggagaatatttctctcacaatattattatctacttataattatggtaaacaataaattttattccatccttgtagtatgaaacatgctccaaggaaatggaatctgtcctttaaatggataacagtatgtgttctaatggcataaaatattactggataaaaacagttgtgtcagtgtctctcctaaggtagtaaatataattgacttattctgaacccattctattttgaatctcccctttcctctcacaatacttgaacattttaatcttttggaatattgtctttctttgttataactattcatttttagcttttgtctccagtgcatgatctcatatttttgcttttatttttagtataagaacatttataaaatcatatttttgttactgcaattgttttatttgttgtgtggcaaatgagaaatcctttatttattgtgctgtgatctctctgtgtggaatgccttggtgagagagatgcttattatgactattatcatttctgaccaagcttctattaatgttatttctaataatacactatcttgattgtactctccagaaaatttttctgtcagtgaaaataaaagaaaaattaaagtaaagctaaggaactgtctataagtcagagtcctgttcctacatatttgttcaaaagcttggcatgcagcaggcccttcctgagctggtgattcagtgttgagtttcaaataataaacaggcagcattcagttggctgggcgaacaagaaaaacacaatggaaaaggaatgagtttgagacttgtaatgggaatgaaagtagtaagccatattccagctaaataagttaaatgcatttggggaataaagaaaaaagagtaagcaagcaataattgcttgaatatttttcaaattacaacaaaaaaaaatactttcttaggacattttgtattaaattgtgcaggataaaaaggtatccttacaatgtttccaggaggcaagaatattatcgtccctggcttgctagtcaggaattgaaacactgggaaagttaagtaactgaaaagtgactaaaattcagatatttgaattctcaaatgagtaccacattaaatagaatatattacctctttcaacaggcacattttcctttataggagagattgcaattacaagtgaaatttcagtatatttttcagtagattacacacacaaacgctaaccatatttaaatgcattctgcctttcaacttcacttcctttcagtatatattaccattaagaaaaagacttttatatcctcactgttcttaatttaaagcaccagcagtaatatgggaagctatgctgaaaaccgctattttgaataatgtgaaataaataaaatgcaatatttcattcaacacaaaactttt

SEQ ID NO: 174 - protein, 1092 aa, Homo sapiens [sequence omitted]

SEQ ID NO: 175 - protein, 5 aa, Artificial Sequence
  Synthetic Construct
  VARIANT 3: Xaa = Any Amino Acid
WSXWS
